United States Patent 9,572,897 (MODIFIED POLYNUCLEOTIDES FOR THE PRODUCTION OF CYTOPLASMIC AND CYTOSKELETAL PROTEINS) - sequence listing, part 5

SEQ ID NO: 4189 - DNA, 549 bp, Homo sapiens
attgtgtgctgggctgagcctcccttcacatggtcacatccccattttaatccaatactccctttccctaccccttccccagtcctgcctctttctgtggcacttattgctggtttccctgagctcctgtttccactttgtgttttttgtggggcccaggaagctaaagctgtgtgtatttgtggatcagacaagtgcagcaagttaatatcattggcttctgaaggggagagtgaggtgatggctgcgtttaagttggatttccttccagaaatgatggtggatcattgctctttgaattccagtcccgtctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcag

SEQ ID NO: 4190 - DNA, 2256 bp, Homo sapiens
aggcgagctgacaaaagggcggcgcgcgtctgaaccgccattggggcccacagctcccttaggactagctctggatcctcccggcgggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgtgtgactgggtgtgtgtgtgaagtgtggggagcaggtgggcagcagcagggaaggtgggtggtgggctcctcccagccccctgctgctgatcctgctctacccgacatggtccgtgtttccctgaggtcatttcaccctcctgtgtttcct

SEQ ID NO: 4191 - DNA, 1322 bp, Homo sapiens
gttctcctccgtcctctctcggttccccttgattcctgcggggtccagggacccggacagcttggggacgtccgcagagcctgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaaccca

SEQ ID NO: 4192 - DNA, 2553 bp, Homo sapiens
accgaaggtgaggctggtgggtcccgcgggcgcggagaaggcgggtgacggtgtgaccctctttagctctcatggattgggagctgggaaaggaatgagaagacagaagtcagagacaagaagaggctaacatgactgataccactataatttagtgaactgcctcttttctaaagaggactccaaaggaaggactggtcatctctttcatatctcaaaaccatggctcagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagagaactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctacatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtgagaaaccctatgtttgtaatgagtgtggtaagtctttcagttataagagaaacctcattgtccatcaaagaactcacaagggagaaaacattgaaatgcaataaatgatgtggtttcttatatgaattctttacaagctgttgtaaacatttagttttaaaaagaaaagcatgctgaaacatgttaatgtaattttaaatcacaagtctaataattattaaagtaccatacggaataactgtctactgtttactagcatataaaataagtatgatcattattattgaactctatcagctatgaagctaaattttaaagtcaactgctcttcctactgactcaaatagtttattttttaaaaatacttatataatacatgcagagacaagatacacaatgattataagtattaatctccataagagaaaatatttatgaactatatttctcattgcactctgtaataaaaagcagttagttgttacttacct

SEQ ID NO: 4193 - DNA, 4332 bp, Homo sapiens
aacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgcc

SEQ ID NO: 4194 - DNA, 1623 bp, Homo sapiens
gcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggagtgagtgtcccctgcgcatcgacgcccactccactatggtgggttggatttggtctgcaggtcataacttggccaacctctggtctaacagggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccacgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgag

SEQ ID NO: 4195 - DNA, 1702 bp, Homo sapiens
gataagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaagacctcagtgaagcccagccagcccaaggagagtgatatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaacattgcagacagtcaggtgtttatagcttttgagttctcttttattatttacacaaagtgatcaggtataacaaaagtgtatgtccaaatggcactgcttgtacatgataatattaactctacccttttcaaaaaacagtccaagcattaaagtacattgcgactgtgtttctgttagtgggagagtataaaattagaaattcccatggtgaagactgctaag

SEQ ID NO: 4196 - DNA, 1934 bp, Homo sapiens
gtgatctgctcttccaagccctgggccgcacctacactgacgaagaatttgatgaactatgttttgaatttggtctggagcttgatgaaattgtccctcctgagatctgccatctcctgggaggtgactcagctttcttcactattgaaacaacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatgttggaccctttttgtgaagattggtctctgtggtgtgattctcttcccaggtgtccctttctcctcccctagtgtccttaagtcctcctccacagggaacatctatttgggctttgatgtttaataaagtagaaagcactgtc

SEQ ID NO: 4197 - DNA, 1973 bp, Homo sapiens
cggggccgcggcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcct

SEQ ID NO: 4198 - DNA, 583 bp, Homo sapiens
gaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaaaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggagg

SEQ ID NO: 4199 - DNA, 3286 bp, Homo sapiens
atttgtgaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatg

SEQ ID NO: 4200 - DNA, 528 bp, Homo sapiens
aagaaacaagatcttgagctgagcaagaacatcccagcatcttcattgactttaaaagtatattctggagtcttccgtggttcactattccagtactacagagtcatttttatctgtgtctttccattgcagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagatt

SEQ ID NO: 4201 - DNA, 886 bp, Homo sapiens
aacagggcttcgtcttctttgcagagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaa

SEQ ID NO: 4202 - DNA, 2610 bp, Homo sapiens
gaacactcatcagtgcgcaggcgcccatcttagttggtcttctagtccggtaaacagagggcctgcccccgacagcttctgcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaaaaaaaaaccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaa

SEQ ID NO: 4203 - DNA, 2403 bp, Homo sapiens
aaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtcggaaagaggccggggcggctgggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagactcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctc

SEQ ID NO: 4204 - DNA, 1032 bp, Homo sapiens
ggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcatctgcgggagcagcagcagcagcggaaccgcttaggcagtgggggaagcggggacggtccgtccgtctcctggtctcgccagacccagccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtgg

SEQ ID NO: 4205 - DNA, 899 bp, Homo sapiens
gctgctgagcggttttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaat

SEQ ID NO: 4206 - DNA, 2791 bp, Homo sapiens
actgcggagcccagagggccagctgcgcggcctgtggacgcgggatggcaggggcgagctccacgccctgtccccgtctaagctaccacctttacttccaccaggctgggaaccagggcttccttggttgtggtcagcaatgagtctggatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacact

SEQ ID NO: 4207 - DNA, 1296 bp, Homo sapiens
gtgtgttgcgcgactggccttgagggagagctggggcctgctcccggagagatacggctatgtcgatcgaaatcgaatcttcggagcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgt

SEQ ID NO: 4208 - DNA, 2526 bp, Homo sapiens
acagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctggcctgg

SEQ ID NO: 4209 - DNA, 1065 bp, Homo sapiens
caagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaa

SEQ ID NO: 4210 - DNA, 1202 bp, Homo sapiens
gtttccggttcgcctccggagccatggcggcggcactgaagtgtctactgacattaggaagatggtgccccggccttggagtggctccccaggcccgggtgagtgcctacattccctgctgtcggagagactctggatctgcagagacatctccgcgcagaggaggagcgctcctggcagcccccgccctagcgattgccagcaactttcctttctgccaggaaatcaacctacctttctctgcctgcaggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccaggtcctgacttccagtccttgttctcaccacagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctggtgagtaactttcttcagccctatcttggtcaattttagctctagaaagccatacttacaccactccaaaattaacagactggaaaaccagagggagaataggcaagttgggaatctataatgtttcttccatcagattaggcaaggcagaagaaggtatatggattggggccagaacttaaaagaaatgtcaagtaaaaaaaggcgcatgtgtagaaaaattaaaaagaaaaggaattatcaatcaaagttgtttttgcctacaaatagtattttgagtctaccttttttttttcttaggagttgtaaataaaacaagaaaataacactattagttattttattactaactatacaactactttaacataacactctcttttcccaggggtg

SEQ ID NO: 4211 - DNA, 1882 bp, Homo sapiens
attcccgggaggggggagcggcgttggaggccaccgtttccagcatcaacaacagcaacttgtgattggcggtgaccggatattcagttgcacatccccacatcaatgcactgccaatggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaa

SEQ ID NO: 4212 - DNA, 5677 bp, Homo sapiens
ggggcgcggggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaattt

SEQ ID NO: 4213 - DNA, 2539 bp, Homo sapiens
cacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccct

SEQ ID NO: 4214 - DNA, 3498 bp, Homo sapiens
gtggagagccggccgacgggagccgcggcggagcctgttgagctcgcgcgggctgccgggagtggtctctgaggcggcggcggcggcggggatcgtctccggcactgacgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccgtctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcaggagcctggccgcggggactgcagggagggtgcctggacccgtggggttgcttcattgagataaagcacacttatcacatagcacaaaggacgtgccatggtgctttccccaaaagttgtgttgcttttatcagttttctaactt

SEQ ID NO: 4215 - DNA, 2000 bp, Homo sapiens
gtagctgggactacacgcacgcaccaccatgcccagctaatttttgtattagtagagacggggtttcaccatgttggccagggttgtctctatctcttgacctcatgatcagcctgccttggcctcccaaagtactgcgattacaggcgtgagccaccacgcctggcggggatgcttaaatgtagcccaatcctccagtaaagaatactaagaaaaagtgtttggaaccgaaccaaaataaaaacttgcgtaccagaagtttgcaggtaatacagatatgcgtacatgactggtgttcagctatttaggtggacttgcttgtctctgcttacctgtgttgctgatgctggtcagcagtggagaaaactgagattagatgctgctaatctcagatgggaggataatttcttaggaggaaggacatttcttgagtcatcagctccagattcctttaaagtggtgaggcttcagcccagagggcgactaacatgagaattcctgtttgtgaggtcattgtcatgacctcatagccaggctgttcaaaatgtttgcccagcttctggcaggatatgagctgatgcctgccccgattctacagacaccatgagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactacatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagcaaaagagccagatttctgaagatcctgagaatgtaagagggcacttaactgtgtggatatttcccttgttaacaaagattgatcacagattaaaatgcttattgatatactcaaa

SEQ ID NO: 4216 - DNA, 4102 bp, Homo sapiens
ctactgtgtgctaggtacacggcgttagaggggggtagggatggatgtggatagaatattgacgtatagaagcctgtctttgtctcaagatacacacccatttcaggagcagtgagttttcaatgcctgaagaaacaagggctccaggattcagagcccctttaccctagggaagaaagaagaggttttcttccctcccctcttttacatccagttcccctgctccatttcaaagcgttggcggtaaagaatgcatgttgagtatcaatattccgtaaagcgaaagagcgtaaagttattttatgaaactggtgaagcatgtttcagcggtcgaaccaagatttaaagttaggtccctaccgcaaattcagcgctctttcttatggtggttactctgggtcctggacctgactgcctcattctggaggcttccagacagccacagttagtgcccaaacctgagaggatggcttcagatggagcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttgg

SEQ ID NO: 4217 - DNA, 1677 bp, Homo sapiens
ctcaatagccaatgtagaaataaaaacccttttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaaggtatatgtcacg

SEQ ID NO: 4218 - DNA, 791 bp, Homo sapiens
cgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaagtacgtggcaaagctgggattcagacccaggcctacctggctccatctcagaggccttcgttcctggacttcttggaatcctcggaacctatttccacttgtccaccaaagcaaaacttcagatacttggtgtctgaggcagtgtcagtagtggctggagaacatgaactctgtaccaactgtgtgaccttgggcaagtccgtgctcctctgtgagcctcagtgtctctgcctgtaaaatgggataatgacagcaacatcaggtttgccaccaggatcatataagaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccagg

SEQ ID NO: 4219 - DNA, 2716 bp, Homo sapiens
gcttccttggattccgcgcttggcaacggctcggcgtcgcgctttggccaaccgctgcgtcgtccctgggcccgaataactgtcgcccgcttccctcagcgtgaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccatccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaact

SEQ ID NO: 4220 - DNA, 1450 bp, Homo sapiens
aacttgtttctggtggagcggaaggcgcgagctgcggaccctcacgcagagatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctca

SEQ ID NO: 4221 - DNA, 1406 bp, Homo sapiens
agaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaagatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttc

SEQ ID NO: 4222 - DNA, 1696 bp, Homo sapiens
ttgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttc

SEQ ID NO: 4223 - DNA, 3652 bp, Homo sapiens
gccgtaaagcgctccgaggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcagacgatggtgacagagcaggccacccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttc

SEQ ID NO: 4224 - DNA, 5229 bp, Homo sapiens
gtcacgctctcccccgccccgagccgacgagccgggaggcgggaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactagg

SEQ ID NO: 4225 - DNA, 735 bp, Homo sapiens
caacggaccctacctcttgtagtgattctcggggccacgggcaccggcaaatccacgctggcgttgcagctaggccagcggctcggcggtgagatcgtcagcgctgactccatgcagttctagatgagcgcttggataagagggtggatgacatgcttgctgctgggctcttggaggaactaagagattttcacagacgctataatcagaagaatgtttcggaaaataggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtg

SEQ ID NO: 4226 - DNA, 2299 bp, Homo sapiens
agttttgggccgagctagggcccgtgctggaagcagtcctttggtgctggtttcggggacaccttggcacgcctggagccccccacatggtggcctcgggcaggagcccacgtgttcctgggaggtagaaaggggcctactctctgtcctgcgcccagactggggctgggggacgggctcccggcggcaggcctgggcggcgctaagagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaa

SEQ ID NO: 4227 - DNA, 1521 bp, Homo sapiens
ggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcattggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgc

SEQ ID NO: 4228 - DNA, 1096 bp, Homo sapiens
atgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggtacaacagcctgagcatcctcccagcagctctggggaagcccgtgcgtgatgtggctgccaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagact

SEQ ID NO: 4229 - DNA, 1047 bp, Homo sapiens
aacacgattcatgatgtgttggatgtggaagcagctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaaaacaataatagcatgcacacc

SEQ ID NO: 4230 - DNA, 878 bp, Homo sapiens
gtggccgatagctggtcctctttctccaacacctagcctgagacttggcggcgcggctgctatcctgaactagcttggtaagtgttgtgtcccgaaccagcgtagagagacctcggaccagccgccttgatgacagcatccgcgtcctccttttcatcatctcagggtgtccagcagccctccatctacagcttctcccaaataaccagaagcttgtttctcagcaatggtgtggccgccaacgacaaactccttctgtccagcaatcgcatcaccgccattgtcaatgcctcggtggaaggtcaacgtattcttcgagggattcagtacataaaggtgcctgttaccgatgctcgtgactcgcgtctctacgacttttttgaccccattgctgatcttatccacaccatcgatatgaggcagggccgtacgctgctgcactgcatggctggagtgagccgttccgcctcactgtgccttgcgtacctcatgaaataccactccatgtcgctgctggacgcccatacatggaccaagtcgcgccgccccatcatccggcccaacaacggcttttgggaacagctcatcaattacgaattcaagctgtttaataacaacaccgtgcgcatgatcaactcgccggtaggtaacatccctgacatctatgagaaggacctacgtatgatgatatcaatgtaagccatcccggccagcccctgacatctgccatcgatcttgcaccaagactgaacttgaacactgacattttgttagtaaagaaaaccggatggtgccttgttaaagggcaagaaaaaagggagggggttggagttttgaacgtagtaagccttaccttaatagaattaaattcatgaaac

SEQ ID NO: 4231 - DNA, 892 bp, Homo sapiens
cctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtttctttttattgaagcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgcta

SEQ ID NO: 4232 - DNA, 967 bp, Homo sapiens
cttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgacacgagataggaaataaacgaactgatagtgtagaggactggctcgggaccacatcaaggaagtaggttagtggttagatcgtgtaggggaacacgggaagctactgagggttttttaaaatggcgtgatatctcagatttagatcattgaactgttaagactgaatcttatgggatcaagactgggaatgctcgggttggcagtatgaagtttggcagtaatccaaggaagtgacagtggtaatgccatttaggtggtcttgatcatgcattggactgcagaaataagggagaaaacaatgtgtcagggtttctggtttgtacctctggttcattggttgtgagggaacatgaggcagggtaaagtttatctaggtaaaatgagttagttttcatgtagactatctgggtgtatatgcaaagactgcagacaatctatactaaaatcctggctctgcctcttgaaagctatgtagtttaggcacatagtcaaaatccagtttcctcatctatgtggtacgcttcagagtagttaatcatgatatgtagtccagtgactggttccctt

SEQ ID NO: 4233 - DNA, 874 bp, Homo sapiens
caacggaccctacctcttgtagtgattctcggggccacgggcaccggcaaatccacgctggcgttgcagctaggccagcggctcggcggtgagatcgtcagcgctgactccatgcaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccagttctagatgagcgcttggataagagggtggatgacatgcttgctgctgggctcttggaggaactaagagattttcacagacgctataatcagaagaatgtttcggaaaataggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtg

SEQ ID NO: 4234 - DNA, 1335 bp, Homo sapiens
gtgacgcaccggcgccgcggcggagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcaga

SEQ ID NO: 4235 - DNA, 1037 bp, Homo sapiens
cttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactgtttgtttgtaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgt

SEQ ID NO: 4236 - DNA, 3768 bp, Homo sapiens
agggtccgccagctcggggccagcgcatggggctgctgagaccgctccggacgtgcgaagcgttcgcggtgcggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaaggtaatgacactcaacgttaggaagctttgtgtacaggtgtcttgtctcttcccccaatccactaacatcataataaaacatgttcatgttgaccaggcactttttatgtgccaggcattgtgctgtaccttatcttattcagtcctcacaacttttaccaggtaagcactgttctcattttactttttggaggaaagagcagagagaggttaggtaacgtgcccacttataattagcaagggcttgagccaagaatgagacccaggtagactatttgcagaggctgagctcttagccactacccttggctgcttcctaactcagaggtattctgaacaaaaaaggttttgtgcacagatgcctttaggaaacactgggctaaacaaaggtaagtggctttcttgactgcaggacttctagagcttcatttgccacagtggtttaagtgcaaagttaggggcattggatgtactgttgcctagactttgtggccaccggaccatcttgtgaaccaaatgacttaatatctggaggtataaagaacactgcgtggaatagggttatcggtgtcaggcatctgaatttgaaacatggcactgctgtctttggaatgttggctcagcctcttgagtttgctcatttgtaaaatgtggagccctgccttcttaggatgttgtgtgcattaaataattcatgttgagggcttcggtgcattcccagacatgttgaaggttcaggaatgtgcctgtccaggaacgtgtcctagcgcttgcggggggctttcaccttcccaggaggtgacgtggttattttgtcttgtgaggtaggtaggacacgttatcatggacccctctttactgataaaagattgagatgccatgaggtaaagttgttcttcgctatagcttcaggttagtcatgattttagtcatttattttacgttcacttttccagagaaacatggacgtatctggctccaagatgctgattctagttagtaatggtgctgatccaagaattggtttccatggcaggcacgcctcttctgggctgctccattcctacctgcaaggctgggttttctcagcctgtcatttttgatgtcacaccaggctgtggttttcattgctttggcagagggaggtacagagtcgtggagtcgggacaggtgagcaaggaggagagaggaaactgaagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaatgtctggtatgttatagctcagttgactattatacctgaaatctaattagagcttcacattcttaaagcggaacgctttgtaaaatgcatgaattatttcccaggccaaatggagcttgaagatacaatatatttatctcaaatcaaaaatactttaggttttgggctggcaggtgcagtgggacaagtcttttatcccagctactctggaagctgagacaggaagattgcttgagcccaggagttcgagtacagcctgagcaacatagcaagacccccccccctcaaaaaaaagttttttcttaattaaaaacaaaaatactttagggtgatttgcaatataattttccaaatgtctcagggattataaatacagacttgcactattatgacgcctctagttatgtatggctattgaagtaaaattaaagactcagatttttttatttgcactagccacattctgcatgttcaaccatcacatttgtctagtggctaccacgtagaacagtgcagatgtagaacacttccatcaccacataaagtcctattggactgcaccactatttaaagatctgagctgaaattgtactgactccagaatctacaatagggcattttgatggtatttaaatagaaatctaggccaggcaccttggctcacactattaatcccagcactttgggatgctgaggctggaggatcgcttgagcccgggagttccagaccagcctgggcaatatagtgagacctcgtctct

SEQ ID NO: 4237 - DNA, 4391 bp, Homo sapiens
aagcgcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagtaacacgtggaggaacatacgttgggaatatcaactgacacgcactgtgctaggatctagaaataccatgtggactccaacacacatagaaataaggaagtggaattccaaaggaaggcaaagtgtaaagtcatctttatggaaatgagtgatgaaggtgaatacctgaatgagatgtcaagaggaggaacacactggagagaagcagtaaagatttaggactgaaccttaaagacatacaggcttgagagaaagaaagcatgtaaagaagacagaaatggttagaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaagtgattctcctgcctcagcctcccaagtagctgggactataggcatgtgccatcacacctagctaatttttgtagttttttgtagaaacagggttcaccatgttggccaggctggtctcgaactcgtgacctcaggtgatccgcctgccttggccccccaaagtgctgggattacaggtgtgagccaatgtgcccagcctgggttctcttttgtaagggcacttactccaatcttgagggttctgccctcgtgatctaataacttcccaaagacccccacctgctaatatcaccttgggggttgggattttaacatacaaatttaggggaaacacatggagaccacagcaatggccaatccttagcgaatcttaggtccttcccagatctaaaatgccaagctacacttgcatttcctttttttaagattatgaaacttcaaaatatatgaactacagcccatattgaaaaataaaatagattgagccatatgcctaaaaaagacctcaagaaaagtttgaggctaagcatgttagtgttacaggaaatggtccaatagagggggaagaaaaaaagcatgctactagccccttttcttgtaccgagaataaaaccatgcagatctcaaacctccaagtctatagtattgaaaagaccaagttcacttctcagaagtctccaagttcagttgactgtggcactctgagacagcttctgtcactcaggctggagtgatacaatcacagcttcccatagcctcaaaatcccaggctcaagacattcttccacctcagtctcctgagtagctggaactacaggcgtgtgccaccacgcctaattttatttttgtagaaacaaggtctcactgttgcccagcctcgtctcaaactcctaggctcaagcaatcctcctgccttggccccccaagtactggacttacaggtgtgaaccactgcacccagctgactcttacttgatttctgtcagggaatcttaatgaacatttcatgactaaagactaaaaaggatgcagctttaagtaaatttaagtcaagttaacagttaaagacaaatcctttccctacattagatcgcctgctgatctgtccactgtgaaagggcagaagactccacagtagcaatagcagcagtgagcatacaggagtcccagatgtttacttctagtatttcccactaaaaggaagctgggctccttggagaaacagctgactccagggcttgaggctgggacagaaaggttacagtatcttatgcatgaaaggagatgctcaaaataataaaggcatgcaaattatgatttggagggaaaaaatatgaggccatagtgtttaggtagataataaatggcagagatagaacactctcttacaacaaatgctgtaaatggacaaagcattagatttggaaaatcactattttgtaaccatcatagttaaagactggtttgggttttagtctggaaagaatcgccaagggagctcctgataaaggaacagggtatttgcacattgcttcccagagattgctagtagtaagtaccacacatagggcaaaaccaggacaccttgaccaggcgctcaaaagtaacatcaatgaagagcagatggagagtatacttgagaagggcgttaagcatgaataaacaattcaaatgcaaaatgagtaacaatttacaagaaaaattgccctgtactccaaaaaacatagaggtcatggaacacataaaggctaaggaactgttccacattaaagacaactgagaacaactaaattcaatgatcctgtactctagagggggggatctaaaacaagctaccaaggatactgggacaacaaaacgaatatggatgataaagagtatcaacattccctgagtttggtaattttactctagttatatgaaatattcttgtacttggaacatatgccgaagtactaaggaaggggtaaggaagcacaaagtgtgcaacaaactcaaatagctcacaggtataagtgtacagagaaaatgaaaaaaatgtggcaaaataataaaaatgagggtaaagattacacaacagctttcatattactctggtaacttttctaaattattccaaaataaaaacgtaaacaatggctgccaaaatgcctaacttggtgaacataagtgtaattcaatatggtaaattaattcaacatggtaaattaagagcataggccttaagagccagccagcctggttttaaatcctccactacttatgatctgagcttgagcaagttacttaacctctgcatctatttccaccaaaggttgagaggttaagacaagagcttagaagagtacctggttataataaacattcaaaatgttatttcaaatagattctaatttttaaataagaggacacatgaaagcattttgaaatttaagaatggccctttcccatgaagcaaggcataaggccaggttgctaactgttgaaagctgacagtatgttcttgattcctgttcttgttgaagttacacactcaattgccaggtatttttcttctgaatttactatttagccacagactatgaaataattctctaaggtgaccagtaacatcagtgaaatggaaagaaaaagttaacacttcaaactttgtgtattcacctgaatagtcagggaactttcacctattttatttaggttttctttttctttttttctttttttttcaaattccaaccagaagctaaatacaattggaaactggtaagcactagttttactccaaaggagtaggatcattcagatttactccaataaaagtatgcaacccttaagcaaagcttttcttcattt

SEQ ID NO: 4238 - DNA, 1569 bp, Homo sapiens
cagacgcgcgagcgcaagcagcgggttagtggtcgcgcgcccgacctccgcagtcccagccgaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttggggg

SEQ ID NO: 4239 - DNA, 3870 bp, Homo sapiens
aaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctatttgcaaagtgcagagcaggcatggattgccaattctggaacagagcaaagccccaacttgccctccactggtgatgtcacacccacccatgaagagcctgcctctagggttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaattgtgaaagaaagaaaaacctcatctaggattcggttcatgcttcaagatgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggtgggtggaacactgtacaaggggccaagaacagtcgggtactggacccctcaaaattcctaaaaatcactaagcctacaattgatgaaaaaattcagctggtacctaaagcacagctaggcagctggggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttcagcaatgtcagctcatgacaaggctgcattatcagaagaggaactggagaggaagtcgaaatctatcattgatgaatttctacacattaatgattttaaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagatgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaaacaaatgagccataagaaagtgggagccttatggagggaggctgacctcagctggaaggactttttaccagaaggagaagatgtacataattttcttttggagcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggctaatctagacgaaatccagatgagttcacctacattccttagagctttaatgactgctgtttgtaaagcagctattatagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacag

SEQ ID NO: 4240 - DNA, 2038 bp, Homo sapiens
tgttttcccaaatctttttatcgttttcttgaggtttttttttttttacacattctgaagtcacgtttggttaaaatgtcgtatcaggaggaggccgaatacagggatttttccccatggtcttacacagcatatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagtgggtgggactgagcagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtc

SEQ ID NO: 4241 - DNA, 1159 bp, Homo sapiens
gcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagggttctccaaaaaatgtggaatcctttgcatctatgctgagacattctcctcttacacagatgggacctgcaaaggataaactggtcattggacggatctttcatattgtggagaatgatctgtacatagattttggtggaaagtttcattgtgtatgtagaagaccagaagtggatggagagagtcccatttcgtggtatgctgtttggaggagattttcacaagtgatgataacctgtttttcttccaactctgactttggaaaacatcgtaaaagataa

SEQ ID NO: 4242 - DNA, 3507 bp, Homo sapiens
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 4243 - DNA, 2249 bp, Homo sapiens
gagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagggtcttgctatgttgccaggctggtctcaaaattcctggactcaagcaatcctcctatgttggcctcccaaagtgctgggattacagacatgagccactgtgcccagctatgcctgcttgttatatcagctactgagagatgagtaccaaaatctggaagtataattgtggatatcttttagttctttcagttctatcagcttttgttttctgtatccaaagctttgttattaggtgcctacatattgaggatttcatgtgtttgcgatgaactgacccttttatcaatatgaaatgttgctgtttattcctagtaataatcctttttcttaaatctactttga

SEQ ID NO: 4244 - DNA, 9312 bp, Homo sapiens
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagccttttttctaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 4245 - DNA, 2847 bp, Homo sapiens
ggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaaactctcttctggagaagataacactttagtacagtcgccaactgatgtctacagcagggaacagtacactgggaagctccgagtgagatcacactccttgagtccaactcacagagaagatggacaaaatattaccccaaagatttgtgaagtttattcgaaaaaatctcctgtttctttggatgatagtgacattgaagctcgccttaatagttggaatcttgggctggacatgaaaacaaaaatgatggaagctaaatttcatgaagaaaagcttaaactgcaacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagc

SEQ ID NO: 4246 - DNA, 1049 bp, Homo sapiens
gctactgtcacatttcagtgatgtcacagctgcaggtggtacagagccagcaccaccatctgatgcccagcctgagtgctggctgaactgagaggaacagggttggtgcctggcactggtgttgctccattcatctctgaggtctcacagccccagcatgagtccatcagcaaagaagaggcccaagaacagcagggtttccaagatgcaagatgagaaactgcgggacgagacagagcagcctgtgagcaaagtaattgagcggaaccgtctgagaacggtgttaaaaaacttgtcgctcttgaagctactcaagagctcaaaccgccggatccaagaactgcataagctggccaaaaggtgttggcattcactgctcagtgttccaaagattctccgcatctcctctggggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggttgatgtgacctggacgagagccagaggtgcgagcagagggtggagatcgcgccatcagctgaaggggaggaatgggtggcgaaattcacgagtctacaaataagatcttccatatggcacct

SEQ ID NO: 4247 - DNA, 619 bp, Homo sapiens
aaataattcacaagttggccatgcagctgagacacattggggacaacattgatcataggatggttcgagaggatcttcaacaggatggcagagatgcactagatcattttgtcttctttttctttagaagagttcaggtgttgctgcattttttctggaacaaccatttgctgtaaaaggaatgaaagagaacctcgtcctcaaactaaaggccacagaaatgggcactacctcctggcccactccctgggcaccatgccctctggtgacctgttggctccactcttgtcactcatgtccagatctgcagtgccagcttctccttctcggtgacatgtcacctccctgccccaatcctggctccaaccctctctggaaaatcgaagtgaaacatttgtctctaatactcaaattcaacatatggctcatctcatctaccttcccatttccatgcctagaggccccactactaccactagcaccgttgggtgtttccttctcaggctctgattctacaacatttacgttcttttctcacctttgatcccctcactcctctgtgacccccttcaagtcttccttcaccactccagtgttttcccataccactcgaccctgc

SEQ ID NO: 4248 - DNA, 887 bp, Homo sapiens
aatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagaggtgagggcctctgtcctgaactttttaacccggtgccacaacctgagggtctccataggggcagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattca

SEQ ID NO: 4249 - DNA, 3505 bp, Homo sapiens
atcgcagcgagagcgtttttgcctgtggagagccggccgacgggagccgcggcggagcctgttgagctcgcgcgggctgccgggagtggtctctgaggcggcggcggcggcggggatcgtctccggcactgacgcaccatgtcggtcagtgtccatgagacccgcaagtcgcggagcagcacggggtccatgaacgtcaccctcttccacaaggcctcccacccggactgtgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccgtctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaactt

SEQ ID NO: 4250 - DNA, 2916 bp, Homo sapiens
atgaatttcctccgcggggtaatggggggtcagagtgccggaccccagcacacagaagccgagacggtgagaggagcagcgggtctgggacttgggaaggggtccgggcagggacggggacggagcactcggagacccgaagagtgtggacttaaatttagacatagttttcgtttagtcaagcacattttataccatgttactataaatgtttcagattctgaaataataggttatgctttggacacactatataatataatatctaatgaagaagaagaagaagtaggcggatcacaagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggtgataagatcgacagacggggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctag

SEQ ID NO: 4251 - DNA, 642 bp, Homo sapiens
gcgttttatgagccatatggaagtctgaagagctgctcagctctgacagctgtttaaattatctgtgacactgcatcccaccattagcagggatgatggattgttgacagtctccatcagaaaaggctggagtcccagtccgtggaggagcacttacagggtctttcctaagtgctgaggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtct

SEQ ID NO: 4252 - DNA, 2391 bp, Homo sapiens
gggggcgggctcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatgg

SEQ ID NO: 4253 - DNA, 1434 bp, Homo sapiens
gagcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagttgtggcatcagctgacacttcaggtgcttgattttgtgcaggatccgtgctttgcccaaggagatggtctcattaagggtgaaccctttgtccctcgtggaaatcattcttcatgtagttagacagatgactgatcctaatgtggctcttacttttctggaaaagactcgtgagaaggtgaaaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccagtgtctgagcagcaggagagagccttcacgctggggctagcaggacttctcggcgagggagtttttaactttggagaactcctcatgcaccctgtgctggagtccctgaggaatactgaccggcagtggctgattgacaccctctatgccttcaacagtggcaacgtagagcggttccagactctgaagactgcctggggccagcagcctgatttagcagctaatgaagcccagcttctgaggaaaattcagttgttgtgcctcatggagatgactttcacacgacctgccaatcacagacaactcacttttgaagaaattgccaaaagtgctaaaatcacagtgaatgaggtggagcttctggtgatgaaggccctttcggtggggctggtgaaaggcagtatagacgaggtggacaaacgagtccacatgacctgggtgcagccccgagtgttggatttgcaacagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgt

SEQ ID NO: 4254 - DNA, 2242 bp, Homo sapiens
acagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggttaatgaggacatctttgatcagaactggtcactgtttccatttccctcctgtcataattcaggatgtgtggaaatttaggcatggtggtaatgagaagaaagttttaggttggctttccacatttttgtctgtacttactttgtagcagttgtttgctaagtagacctgagagttaatgatcacatcatctaaattctcacttttgaaaggctggtactgttagaatggttaattttggttctgatactatttatttgttttcctttggagtgattctaaaatccataggggagtaaaaatattgcattcaagagtcagttttagtccaggcgtggtggctcacgcctgtaatcccagcactttgggaggctgtagcaggagggtcacttgagcccaagagttcaagaccagcctgggcaacctggtgagaccctgtctctatttt

SEQ ID NO: 4255 - DNA, 1933 bp, Homo sapiens
agaaagatggcggcgatggcggtcgggggtgctggtgggagccgcgtgtccagcgggagggacctgaattgcgtccccgaaatagctgacacactaggggctgtggccaagcaggggtgagggccggacctccacgagcggaatgcggggtccgaactcggggacggagaagggcagactagtcatcccggagaagcagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctg

SEQ ID NO: 4256 - DNA, 1862 bp, Homo sapiens
agtctagtgggataccaggccctgagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcaggtcaggagttccagaccagtctggccaacatggcgaaacctcgtctctactaaaaaaaaaaaaaaaaaaaaaaatacaaaaattagccgggcgtggtggcacgcccctgtaatcccaggactcgggaggctgagacaattataaattcattaacccccagaactcttggctagacttcataaaggcaaaaactgtgtttgccctgttaactgctttatcccaccactagaatataagcttcctgaagacagaagacttctgttattttgttcacagttaccaagcatgcctactttgttaaatttatgaaagaactttaaagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaa

SEQ ID NO: 4257 - DNA, 1401 bp, Homo sapiens
cttcactcccaacaatggcggctccgagcccgagcggcacccccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgt

SEQ ID NO: 4258 - DNA, 8446 bp, Homo sapiens
atttccggcttctgggactcgggtgcaccacggcttccggtgtcatggctgcttgaagtcccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaaggtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaaggagttgctttttaatttc

SEQ ID NO: 4259 - DNA, 2327 bp, Homo sapiens
agcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgca

SEQ ID NO: 4260 - DNA, 2099 bp, Homo sapiens
agcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctgttccattcctgctggatttgaagaggagagtctcctccagcctcattgaaactctttttgtggatttgatgaccttatggatattgccaaagtttaaggcagtggattttagtcccagccttgcagcttacacacacacctggttgctccccagatttctggagattctcattcagtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 4261 - DNA, 3001 bp, Homo sapiens
aaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaagggtctcacatttag

SEQ ID NO: 4262 - DNA, 1816 bp, Homo sapiens
gtggggcgcatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatac

SEQ ID NO: 4263 - DNA, 3086 bp, Homo sapiens
agcatggaaaagacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacgacagaggtgacagttctacactaacaaagcaagaacttaaattcataggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgccttta

SEQ ID NO: 4264 - DNA, 2476 bp, Homo sapiens
gtgcggaggggcggggcgtgtggaggccgggacggcgcccccggccggcggtgaggccggctcagcgcggagcagctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagggcggagggaggagcgggctcggcgggag

SEQ ID NO: 4265 - DNA, 5175 bp, Homo sapiens
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 4266 - DNA, 833 bp, Homo sapiens
gagcgccggagcggacgcccccagggagctggggacacccccatgggacagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgc

SEQ ID NO: 4267 - DNA, 1785 bp, Homo sapiens
gctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctgggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcag

SEQ ID NO: 4268 - DNA, 3438 bp, Homo sapiens
aagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattc

SEQ ID NO: 4269 - DNA, 1885 bp, Homo sapiens
ggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 4270 - DNA, 309 bp, Homo sapiens
gggagaaacgagatgggggtgaagctggagatatttcggatgataatctacctcactttccctgtggctatgttctgggtttccaatcaggccgagtggtttgaggatgatgtcatacagcgcaagagggagctgtggccacctgagaagcttcaagagttagaggaattcaaagagaggttacggaagcggaagcggcgggaggagaagctccttcgcgacgcccagcagaactcctgaggcctccaagtgggagtcctagcccctcccctgatgaaatatacatatactcagttccttgttattcaa

SEQ ID NO: 4271 - DNA, 1937 bp, Homo sapiens
gcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggacccttagagtccattcgcgtgccttctattgaagagcaggaactgacggttgttttaggcctctcaattccagaaagtttcctggggacctgtccggtcggaaagtcgagggacagttgtcttggtatttgtaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttg

SEQ ID NO: 4272 - DNA, 884 bp, Homo sapiens
ccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaattttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatgggtatgaactggtgtctctttctcagcactggggattaggggaggtggtgggggtggatgggtgacgcataagaaaaatacaattacgggaaggctgcactgactctcagcagtttaggtgactcgtagcaattaaactgtatctgc

SEQ ID NO: 4273 - DNA, 1220 bp, Homo sapiens
atgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagatcaaaagagaaaatgaagaagattgaagcttcaaagcagaaaaatgaagggaatatgtatcattcaccattacctta

SEQ ID NO: 4274 - DNA, 1317 bp, Homo sapiens
ggatggtgaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctgtagatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctg

SEQ ID NO: 4275 - DNA, 2255 bp, Homo sapiens
cttggttctagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgacc

SEQ ID NO: 4276 - DNA, 1231 bp, Homo sapiens
gaagttgctggctgactgggcttgcgaggaaaccgcctcggagctgcagccgaaggccaaggaatcactgaagatcggcgagggaggacagggggttcatcatggccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaa

SEQ ID NO: 4277 - DNA, 683 bp, Homo sapiens
aggaggcagatcctgaaagagcttgccctgtgtctgcggaggcaagagatgtatgggcctagagcagctagcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagat

SEQ ID NO: 4278 - DNA, 560 bp, Homo sapiens
gagccgacgagccgggaggcgggaggcggcggccgcggcggctgctgctgctgcagtgggacaggtggcggcgaccggcggcgtccgaggagtctcttctgtatatacagaaatatgaatgtgaatgaagtggaaggaagaaaatcaaatagcttgccctttcttaaggggaaacaagtcaatttggaaaggtcccagcgttgtatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcac

SEQ ID NO: 4279 - DNA, 1245 bp, Homo sapiens
ctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctct

SEQ ID NO: 4280 - DNA, 1407 bp, Homo sapiens
agagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgagccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcgg

SEQ ID NO: 4281 - DNA, 1718 bp, Homo sapiens
agttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctaccaagaactactccgtcgtcttcccccacgatga

SEQ ID NO: 4282 - DNA, 2525 bp, Homo sapiens
cccctcgtttctccctccccgcctcctccgcagaagccaagtgctgttccaccaactagtcccgttgcaggtgaaatgcaaagactgtgaggagaggagagtaagtataagaatgagcattgaactacaatcagtttctaatccagttcacagaaaggacttagttattcgtctgactgatgacacggatccattttttttatataaccttgttatatctgaggaagattttcaaagtttaaaattccagcaaggtcttctggtagacttcttagctttcccacaaaaatttatagatctccttcagcaatgtactcaagaacatgccaaagaaattccaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggaagaaaaattatcattgatgcaatcactagatgatgctactaagcaactggactttacacgaaagacattagcagaaaaaaaacaagaattagataagttacggaatgaatgggcgtcacatacagcagccttgacaaacaagcattctcaggaactgacaaatgaaaaggaaaaagccttgcaggcacaggttcaatatcaacagcagcatgaacaacagaaaaaagatttagaaatcctccatcaacaaaacatccaccagctacaaaacagactgtctgagttagaagcggctaataaagacttaaccgaaagaaaatataaaggagactccactattagagaacttaaagcaaaactttctggtgttgaagaggagctacagcggactaagcaagaagtcctctctttgcgaagagagaattctacactagatgttgaatgccacgagaaagaaaagcacgttaatcagctacaaacaaaagtggcagttttagaacaggaaatcaaggataaggaccagcttgttttaagaacaaaagaggcatttgatacaatccaggaacaaaaggtggttttagaagaaaatggtgagaaaaatcaagtacaactaggaaagcttgaagctacaataaaatcattatctgcagaacttctgaaggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtatgcaaattacaagaacaattagaagctacagttaaaaaacttgaagaaagcaaacaacttctaaaaaataatgaaaagttaatcacgtggttaaataaagaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaaggttcagtttaatttgcagtttacaaaaccaaatgcatcactaggagatgttcagtcaggagcaactattagtatgccttgctcaactgataaggaaaatggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactg

SEQ ID NO: 4283 - DNA, 1590 bp, Homo sapiens
actcagcatcgtttccttttcctccgctggagcagctatggcggcggtgaagaccctgaaccccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaa

SEQ ID NO: 4284 - DNA, 1041 bp, Homo sapiens
tctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggcgatcagtgggtgaccgcggctgcgagggactttgtcatccgtcctccaggatctggggagaaagagccccatcccttctctctctgccaccatttcggacaccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgt

SEQ ID NO: 4285 - DNA, 2608 bp, Homo sapiens
accttagcaaccttctcctggtgcagagtcctaagaggtttggggctccataaccacaaaggtggaagcgaggggaaggctgctccccaccacctcgcccccaccgctggggaagggttaccatgacaaccaacctggccggcaatcagagaggatggggccactgctggtcgccctttctctcagagtaaaagtaattgtccaggagagtggtgtttgggtgtggaagggcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagttttt

SEQ ID NO: 4286 - DNA, 2312 bp, Homo sapiens
agagaggcagccttcagacctatgttcccagaaatctctacgtttgtgcctttcccaactagagaattaactcttgcggggcacaaaacagcctctatttctttgcgtccccagcgcctgtttgttgaagactgagttgaaggagtagcaggtggtgttaatttgtcaaaaagatgagttaaggtgctgggggcgagggggaacacccccacggccctccccccacagcaaggcagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtct

SEQ ID NO: 4287 - DNA, 4509 bp, Homo sapiens
gaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgc

SEQ ID NO: 4288 - DNA, 1928 bp, Homo sapiens
cgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccct

SEQ ID NO: 4289 - DNA, 291 bp, Homo sapiens
atgtgtcataccagctgctcctcgggctgccagccagcctgctgcgcgcccagcccctgccagccagcctgttgcgtgcccgtgagctgccagtcttctgtgtgtgtgcctgtgagctgcaggcccattgtgtgtgcagccccctcctgccagtcctccctgtgcgtgcctgtgagctgcaggcctgtcgtgtatgcggctccgtcctgccagtcctctgggtgctgccagccctcctgcaccagcgtcctctgcagacccatctcctacagtatctcttcctgctgctga

SEQ ID NO: 4290 - DNA, 321 bp, Homo sapiens
attacacgcatgaaacactgcttatggcctgtttccgcctctgtctcctgggtaatggggaccacaggtgcgcaccgccacgccaggctaaagaaataaagtgatgtactgtatgaagaagtgccgtaaagtgatattaaattttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccg

SEQ ID NO: 4291 - DNA, 800 bp, Homo sapiens
gaaattattggagaagcacaaaaggccatgggaaacatgtgcagagatcaagcagtttggctggtccagtcaagttccaggtcaaacatttgagagccaagggaccaagacccgaaccctgcggctgtggccgagaacgctgcactgagcctgcgcgcaaagcctctgagtaaaaggagaaagtaaccccctaactaggcctctggagggcgaaagctgctgcacaagtctgcgcaggcgcgccccgctgacgaacactcatcagtgcgcaggcgcccatcttagttggtcttctagtccggtaaacagagggcctgcccccgacagcttctgcttccgggtcacgccttgacagcggctttcaacccccacctcagcccagcaattcgtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagccttta

SEQ ID NO: 4292 - DNA, 454 bp, Homo sapiens
cagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaaggcttcctattctttacttgacttaagatgaaaactacagccacgtgaaccctaacttgttggtattctggactctcctggtagaaatgacttaattttactactccatacagcc

SEQ ID NO: 4293 - DNA, 1424 bp, Homo sapiens
gtgcggaggctgagccggccgcgggcgcgaccggaggcaggcagaagaaattagaagtggccatggaagaagaaggattagcagatgaagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaa

SEQ ID NO: 4294 - DNA, 1420 bp, Homo sapiens
agagctggagcatctcgcagccctacaacttctttgcggcgcttggtctgtctttgcgttgcgagatcaggatcggtgtgttgctcagacaccggccgaacgccaccggcacgtctaggagtctcctgtgcctggaagaggctggtttcattcgattctaaaagaaacggatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaag

SEQ ID NO: 4295 - DNA, 554 bp, Homo sapiens
gagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttg

SEQ ID NO: 4296 - DNA, 2996 bp, Homo sapiens
cttctctctcacgcctagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagaacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttc

SEQ ID NO: 4297 - DNA, 3127 bp, Homo sapiens
ccatatatattacttatttcctctttctttttatcatgactttttcatagcatcttattttttggatgcatcatcttatctttccaaggaaattagggtttttggggtctaagttttctttggttcacgtattatctggttcctcttttttttttttttcctctctgttactccagtttatctcttttatgttggaggccctcctcagatgccttacccaaggctatctgtctatatctgagtgaggccctaaaaggctagccaagaagttctgtgtttggggtggggtggatggtagctaaatggcaagccaggctttttggagggactcccaaatgtctggatctggatggctgttccctagactgttcagtttttctggaaaggacttgtgccatctgctttctggggagctgctggtattctcagggtagggttgggagtggtttggcgctgagtcccttccactgtgcctgaccatggccctgcatctggatcctctcaggactcctgttcaggggcccagggggactggttttgcatagaggttgcctgcagtggtgggtgccgccaatagggtcaggctctgaacttcacctttggctcctggtgtctgcagcgcctgggtatacagggcttttgcaggctcagtcaacctgactccttacacacccacatctgcagcctttaggtatggcatcctctgcttccctaacccagggattggtcacacctatttgctgctttctagaaatgtatcagaatccctcatctgctgctggcttgccttccctctttctattattatgggcttatatttttgtttatttttgtagagatggggcaacataataagacccccttctcaaaaaaaaaaaaaggttgaggggagtctttgctaacaattggatttagggaaagaggggccaggaattaaaataactacaggaagtaagataactacagggtatgcccagctgtgcccttggaggcctgtctggagtacagtcagtatttagtgcacggagagctttggctgcacttgctctggggcagatcagtcactgctgatgcgtcccatggtgcatctctcctgatgatcttgatgctgttgcaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtttgtgaaggaagtctcgtttatgaagcagcattgtttaataaatgggtggaggccctgggtctgaggatggtccagtagtgttggggtcaggaatcactgagacagcaacccctgtggtgactgtccactgcaggactgggtggggtcagcacagtgagatatgttagcaggtgtgctgacagcagaatgcaagtgaccttcatctatgtctgtcttaaaggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtc

SEQ ID NO: 4298 - DNA, 2961 bp, Homo sapiens
gggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 4299 - DNA, 1832 bp, Homo sapiens
gaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatat

SEQ ID NO: 4300 - DNA, 1729 bp, Homo sapiens
gccctctcaagctgcttccagtgaatgctacacacctgcaccatggtttgtccgacatccttagccaagatcaggattggctatgttgaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttgggaaaacggaaacttggaaaacttacatcacgtggcttagtaaatggcagaactgaaatataattacaagtctgtctaaatgcaagacacgttgttctttccacttcatcacgacgcgtctttgtaatatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaatcacaagtcctaccactcctgccttccaaatccctgcagaaaacaagcagatggttagtattattcaatggataaaattgctatttgccttagatttctctttttgtaaacaaagttattttgggtacagaactcacaaaagaagagcacgtgcaattgtttaaccatttta

SEQ ID NO: 4301 - DNA, 6149 bp, Homo sapiens
ggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 4302 - DNA, 8189 bp, Homo sapiens; identical to SEQ ID NO: 1244

SEQ ID NO: 4303 - DNA, 2191 bp, Homo sapiens
aacaagttaagctgaagaccgaagcaagagctggttcaggtggcagccacagcagcctcagggacctcagcaactatggcctcctgcccagactctgataatagctgggtgcttgctggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggactta

SEQ ID NO: 4304 - DNA, 2330 bp, Homo sapiens
ctggatttccgaggctggaggcgcctggccggctgggtggggaccaccatgggcaacgcggccggcagcgccgagcagcccgcgggccccgccgcgccgccccccaagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggctgtgcccacaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacc

SEQ ID NO: 4305 - DNA, 2031 bp, Homo sapiens
atagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatgcattgctcattcttgaagtcgtcttcatcttctgtgcagaggcagcatagtacagcagttgagagtaaggcctctggagctacactgaatgcctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaatt

SEQ ID NO: 4306 - DNA, 566 bp, Homo sapiens
aaaactctctgaagtttttatttacccagcgctctggctcccacttctgttttaaaagattataagtaaatactctgctctttcaagtgaaccaaacctatcaaacctgtttagaaaataaaccaggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaa

SEQ ID NO: 4307 - DNA, 1651 bp, Homo sapiens
atggagaagactgagctgatccagaaggccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaacc

SEQ ID NO: 4308 - DNA, 2035 bp, Homo sapiens
aaggcctaagccggcgccgagagagccagccgcgttacgatggagaccgaaagtggagaaaaggccagctgtgggcaaggagtgcacggccgccatcttggttgtgggaagtctcgtctaggctgtcctctctccagttgggaggaccaagatggagcgaaggatgaagtagcaagtgcacgtctttcttgggagcaggatgttgcgcaagtttacacttctgaccccatcacactgcttcccactgagatgcaagagacctgccccgaatacagtacaggagcatcttcaaagtacttccagtgggtgccctggacagcagctaagaaccccggggtaaaacgagtttcctctctactgttacaaatcagaaacctcctccgtaaaagcctcagatctgggaaacgcggatgcatatgccaacttttgagtctcagtctgcgcctgcgcacgtgacctctacacgtctcctctgcgcctgcgccgctcaagttagcgcgaggctactcagtcgagggtgggactacgcttcgcgttttgggattgggcgctgaaggccaaaccggacgacgcggaaatgacgtcacgccgggggccctgccgcgcggtggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgtgggccatgtttgaggattgccccagcattcagttctatgagtaataaatatccacaggctgttttcttggaagtcgatgtacatcagtgtcagtacttattcctttgaagataggaagatgttatgttgatgtcattattacagatgtcattatggctgcattagttaagaagagtagcacattattaattgcttcagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatatggatttaatgccttttattaacaaagctggttgtgaatgtcttaatgaaagtgatgagcatggatttgacaactgtttacgaaaagacacaaccttcttggaatctgactgtgatgaacagctgcttattactgtggcattcaatcaacctgttaagctttattccatgaaatttcaagggccagataatggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactatatttgttcagtcgaatcaaggtgaagaggaaacaacaagaatttcatattttacttttattggtactccagtccaggcaacaaatatgaatgacttcaaacgagtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagctt

SEQ ID NO: 4309 - DNA, 912 bp, Homo sapiens
aggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatg

SEQ ID NO: 4310 - DNA, 1652 bp, Homo sapiens
gaatccttccgcagctgcacgacgcctgtgtgtctggcctttccttcttcttctcttccccggcagcacagtgtggctgtttgtctccttgcccgccaaagttctgcccagtccaacgactccacgcagctcgcccttggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgt

SEQ ID NO: 4311 - DNA, 548 bp, Homo sapiens
acccgaattgccacgaggcttcctttaggggagggatcgggggagggatgggagcaaggctagcagaggagggtcggcatcgcctgtggttccgaagcccgttagtcatcgttgtagcgttatcaactgtggagacctcaaacttgattcttcccccacccctggacaaaaaggaaaagtgttatttctgtgcagtaattggccagcacggacgctccatttcttctcaaaccttcctcaccatcctgcaggactagagaagcatgaggtttccctgtaaccagaaaaacgaatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactgga

SEQ ID NO: 4312 - DNA, 561 bp, Homo sapiens
aattcggtgagtgcggtccttggagtgggtctacagccaggtttcctaacccaggtaccggacctaccgggattgctgcgatctgtttagagcccgtgcagaaagtgacaccgcacgtccttgcgtttcgtgcccttgccccccgccccctagcctcagcgagacagctgccgcgggccctcccgcagcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatg

SEQ ID NO: 4313 - DNA, 3268 bp, Homo sapiens
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttc

SEQ ID NO: 4314 - DNA, 2224 bp, Homo sapiens
gccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatg

SEQ ID NO: 4315 - DNA, 785 bp, Homo sapiens
actataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaa

SEQ ID NO: 4316 - DNA, 3468 bp, Homo sapiens
agcacgggctgccgcggcagcagcggcggagcagcagagaggccggggagcggcggctggctcacgcgcgtcgcgcgggccgggatgagggactgtggcggcgcggcccgcgcgcagccggccgtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcggttggagtgggtggagatcatcgaaccgcgcacccgcgagcgcatgtacgccaacctggtcaccggtgagtgcgtgtgggacccgccggccggcgtccgcatcaagcgcaccagcgagaaccagtggtgggagctgttcgaccccaacacgtcccgcttctactactacaatgccagcacgcagcgcacggtgtggcaccggccgcagggctgcgacatcatcccgctggccaagctgcagacgctgaagcagaacacggagtccccgcgcgcctcggcggagagcagccccgggcgcggcagcagcgtcagccgtgagggcagcaccagctcctccctggagcccgagcccgacactgagaaagcgcaggagttgccagcgagggccgggcggcccgcggcgtttgggacagtgaaggaggacagcggcagctcttcaccaccaggagtgttccttgagaaggactatgagatttaccgggattacagtgcggacggccagcttcttcactacaggacctcctcgctgcggtggaactcgggcgccaaagagcgcatgctcatcaaggtcgctgatcgggagcccagcttcctcgccgcccagggcaatggctacgccccagacggcccacctggggtccgctcccgcagaccctccggcagccagcactcacccagcctgcagaccttcgccccggaggctgacggcaccatcttcttcccagagaggaggccgtcacccttcctgaagagggccgagctcccagggagcagctccccgctgctggcccagccccgaaagccctccggggactcgcagccctcctccccgcgctatggctatgaacccccgctctacgaggagcccccagtggagtaccaggcccccatctacgatgagccccccatggacgtgcaattcgaggctggcgggggctaccaggccggctctccccagcggtcgccgggccgtaagccccggccgttcctccagcccaacaagcagggccccccctcgccctgccagcagctggtgctcaccaagcagaagtgtcccgagcgcttcctgagcctggagtacagtcccgccggcaaggagtacgtgcggcagctggtctacgtggagcaggcgggctccagccccaagctgcgcgccggcccgcggcacaagtacgcgcccaaccccggcggtggttcgtactccttgcagcccagcccctgcctgctgagggaccagcgcctgggcgtcaagtccggagactacagcaccatggagggacctgagctgcggcacagccagccgcccacgccgctgccacaggcccaggaggatgccatgtcctggtccagccagcaggacaccctgtcctccacaggctactccccgggcacgcgcaagcggaagagcagaaagccctctttgtgccaagccaccagcgccacccccactgagggccccggggacctgcttgtggagcagcccctggccgaggaacagcccccgtgcgggaccagcctcgcccccgtgaagcgagcggaaggtgaggccgaaggggcgcggggcgcggccgagcccttcctggcgcaggctcggctggcctgggaggcgcagcaggcccacttccacatgaagcagaggagcagctgggactcccagcaggacggctctggctacgagagcgacggcgccctgccactgcccatgcccgggccggtggtgcgggccttcagcgaggacgaggcgctggcccagcaggagaacaggcactggaggaggggcaccttcgagaagctaggcttcccccagatcctgctggagaagagcgtctccgtgcagaccaacctggcctcaccagagccctacctccacccctcacagtctgaggacctcgctgcctgtgcccagttcgagagcagccggcagagccgcagcggcgttcccagctccagctgcgtcttccccactttcacgctgcgcaagccctcctcggagacggacatcgagaactgggcctccaagcacttcaacaagcacacgcagggcctcttccggcggaaggtgtccatcgccaacatgctggcctggagcagcgagtccatcaagaagcccatgatcgtgacaagcgaccggcacgtgaagaaggaggcctgcgagctcttcaagctgatccagatgtacatgggtgaccggcgggccaaggccgacccactgcacgtggccctggaggtggccaccaagggctggagcgtgcagggcctgcgggacgagctctacatccagctgtgccggcagaccaccgagaacttccgcctggagagcctggcccgcggctgggagctcatggccatctgcctggcctttttcccgcccacccccaagttccactcctacctggaaggctacatctaccggcacatggaccccgtcaatgacactaaaggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgacagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgccc

SEQ ID NO: 4317 - DNA, 1894 bp, Homo sapiens
ggatagttcctcccggccacgccgcgccggctctgggcactcagcatcgtttccttttcctccgctggagcagctatggcggcggtgaagaccctgaaccccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagc

SEQ ID NO: 4318 - DNA, 2315 bp, Homo sapiens
tgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggataaaagatgaagtatttgaagaaacagaaaaaaacttccgaatgcaagaaagattgattaagtcttttatccgagacctgtctctctacctccagcacatccggttcattttatcaaaaccagtttgaaaatcaaatattgaatgcaaaagctaggaagctgtaaacaggaaacgtaaacgagaaagaacaagcagtgaatacgagagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaat

SEQ ID NO: 4319 - DNA, 1042 bp, Homo sapiens
attccgcgcttggcaacggctcggcgtcgcgctttggccaaccgctgcgtcgtccctgggcccgaataactgtcgcccgcttccctcagcgtgaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcag

SEQ ID NO: 4320 - DNA, 4400 bp, Homo sapiens
tggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagcaaaagagccagatttctgaagatcctgagaatacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactc

SEQ ID NO: 4321 - DNA, 636 bp, Homo sapiens
atggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatagggaaaaaagaaacatgggatacagcagaagaagactctggaactga

SEQ ID NO: 4322 - DNA, 2280 bp, Homo sapiens
actgaccccgctgtaccacggccctcttgcggacagccccggggacgtcgttgggacatcgctgggaccccgggctctgcagccacaaccatgtttggccggaagcgcagtgtctcctttgggggcttcggatggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggggatcaagcttgaagagcagaagccgggaccccagaagaacaaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcggggcac

SEQ ID NO: 4323 - DNA, 1644 bp, Homo sapiens
gtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccaaagcaggaaaatggggctaa

SEQ ID NO: 4324 - DNA, 2530 bp, Homo sapiens
gatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 4325 - DNA, 932 bp, Homo sapiens
gcttccggcaccggccgaggtgcgggtcgcctccagagatcctgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttacaaatattgacatggttcaatgtgatgtgtgcttattatctaacagaatgtccaagtcattcgatacagaattatgaatcctccctttgggaccaaaaataataaagggacagatatggcttttctaaagactgctttggaaatggcaagaacagcagtatattccttacacaaatcctcaactagagaacatgttcaaaagaaagctgcagaatggaaaatcaagatagatattatagcagaacttcgatatgacctgccagcatcatacaagtttcacaaaaagaaatcagtctgatcatctaaatcacccgaaaatttcagcaagcatccaatcttttcttctagagatttctataaaaatatacaaagtgatcaaaaagtttcttaaaagcaacaacagaccagaaatgactcacaccaccttatagctatacaagaaaaagactagaaaccaaaatgctattttaaagtagtttcttccgccggggcagcaagagcgaaactccatctcaaaaaataataataataataaataaataaagtagtttcat

SEQ ID NO: 4326 - DNA, 1674 bp, Homo sapiens
atagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaatt

SEQ ID NO: 4327 - DNA, 2747 bp, Homo sapiens; identical to SEQ ID NO: 3944

SEQ ID NO: 4328 - DNA, 1758 bp, Homo sapiens
cttgcgtccttccggctccgtcgtggaagcaggactgcgccgcgtcttcctcaaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgc

SEQ ID NO: 4329 - DNA, 1935 bp, Homo sapiens
gagcggaccctcgcggcggccatggcgtcggtggtggaatacaagggcctcagggccggctaccactgcggctactgcgattccaaggagggcaaagcgtcctgcggcatgtgggcacattccatgacagtacaggattatcaggatctcatagaccgaggatggcgaagaagtggaaaatatgtgtacaaacctgtcatgaatcaaacatgttgtcctcagtacacaataaggtgccgacctttacaatttcagccttcaaaatctcacaagaaggttttgaaaaaaatgttgaaatttctagctaaaggggaggttcccaaaggaagttgtgaggatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgaggttagtacctgtctcctttgaggacccagagttcaagtcgtctttcagccagtccttttctttgtatgtcaagtatcaagtggccatacaccaggatccacccgatgaatgtgggaagactgagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctagcccccataattgggatttatcattttggaggattctttctagagcaagatacgctcaaattctcctgtttgtattttgtaaaatgaagaagtgaatctaagtaacttaatcacagttgtgcattttttttggttctgttagagaaattaaaacagactgtttcctca

SEQ ID NO: 4330 - DNA, 5697 bp, Homo sapiens
aaaaataatgccatttttttgaatgatgaactatggtataatgcatttagtgttcattccaaacgtcaatcaataaataacatgggcctctagctataagggaaattctataggtaaaagaactgattgacccccacccccataggtgctgtcctgctatggaatccctttgctcagttttctcctgtccaatcaggtggaatgtttcacaggcacatggtttatacagctcaaaataacttgggacctgtgagctgacaaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaggcctgtctgcatggagcatatagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaatg

SEQ ID NO: 4331 - DNA, 2882 bp, Homo sapiens
aagcatgtgcacaggctgctcatgagttcctaaacgttgcgtttgcaacactaccagtgttttgtacgggcgctggcgcctgctcacagccttccacgtgaccggaaaaggccttcagcgcataaagtgggagaccggaagaggcggagacgatccgatgctcgaactccgccccctcttctccgcgtaggcccagctccctgaagcggctgtttcgagccacgcgcccatcgggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 4332 - DNA, 1304 bp, Homo sapiens
gtggttctcaaacctggtggcccattagaaattttaaatgcctgagttccaccttggaccagttctgttagaatctctgcatgaccagccaggatatcagtacttcttaatttgcagccagggttcagaaccactggcctcgagctttttctgggacttctaacacttgtcattgtccctgggcaaagcatgagcatatacacatgtttatcaaaaagaaaaggaacttatatctagctccactggtccaactttagaaactaggaaacgagtaaatggtgtgtgtgtccccatttgtgtgtctgcatctgcataaggtggtgtgttggtgggcacccttgctaatcagagggtgtgctgtgccataccactctggtgagggtatgaatctctgtgtgactccttcctttgtttctcacagggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtg

SEQ ID NO: 4333 - DNA, 1840 bp, Homo sapiens
atgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccaca

SEQ ID NO: 4334 - DNA, 2873 bp, Homo sapiens
agcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctcttgtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatcc

SEQ ID NO: 4335 - DNA, 1947 bp, Homo sapiens
gggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaaggtgtgcatataaaattttttcccaaacaaaaatactgctaatacttattcaggttaaaaaaagtagcagcagtcatgtacaaaatttagctctgagtttgcttgacaaccaaagcaaaaaggaacatataatggacagtatagctatctttgtgaaataacaggaagcactccagtttttctagaaagattaacatttttctagttttaaacttctggagaaacatattttgtgatagtttataaaagaggcagtaaacaacacagtagatactgacaacataataaatcctgaaagcagttttatgtaatatatagacaataaaaaataaggtttttcttatagacctgttaagtctgtaaagtcatttatatagggaatttattgttatatgtaatttctatgcttatttcttgtgaatttgcccaaaagtaaggattggagagttagtactttatagaccaatattttgtttagatggattgatgttttgaatgtatgctattcaagtaacccttcttaattatatataatggtatgaaaaaagtttttaatcccttttaatcttatgattgtggaattatggttttgatggccattattactatttattcagatatgaatggagtgagtgttctctgtgccatttgttgtgggggacaggagatgctatttgggaattctggccactgccatatgcttagcttgtggataaaataatggagagaacagtaaacttaactttggctactcttttattacgtaaataaaaattaatgttc

SEQ ID NO: 4336 - DNA, 2360 bp, Homo sapiens
agagcctgagcaggcagggcacctccaggtgggcaggagctaccactcagcaccatgagcaccgccacaggcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagaaggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcaga

SEQ ID NO: 4337 - DNA, 3795 bp, Homo sapiens
aaggtccgcggggggcgagcgcgggtcgggggccgtcccggacccaccatgaacaccaagaagagagggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttca

SEQ ID NO: 4338 - DNA, 1774 bp, Homo sapiens
gctcctcgcttcctccgcggtcttccgagcggtcgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaatggtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtc

SEQ ID NO: 4339 - DNA, 2483 bp, Homo sapiens
atcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggtcattggaatgttttacaagagggaatttaatggcgacttgctacatgatgttagaacagaccaaatacaaagcttgcctttgaacctggttttgtttcttaattattttggaaatagaaactgacatttggagaaatcacattatgagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatatttt

SEQ ID NO: 4340 - DNA, 1991 bp, Homo sapiens
agagcggaggcggtggtggtggcggccgctggccagttccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagat

SEQ ID NO: 4341 - DNA, 930 bp, Homo sapiens
cgccgggacttcccgccccttcctgggggctgcctgacctcggactgtggctgggggtgcatgttacgcagcggccagatgatgctggcacagggccttctgctgcatttcctgcccagaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttg

SEQ ID NO: 4342 - DNA, 1556 bp, Homo sapiens
agaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgt

SEQ ID NO: 4343 - DNA, 3305 bp, Homo sapiens
tgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatgggggccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacag

SEQ ID NO: 4344 - DNA, 3112 bp, Homo sapiens
ctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggctta

SEQ ID NO: 4345 - DNA, 463 bp, Homo sapiens
gtgcggaggctgagccggccgcgggcgcgaccggaggcaggcatctgaatttcatttgaaaatgaaatgggctgcacagtctggagaagtgtactataccttgttatagcacgttttggaatgacccagaattcagaatgaaatgggcagctatgagccccatccaaagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaag

SEQ ID NO: 4346 - DNA, 5228 bp, Homo sapiens
cgagggaggagactcccgtcagtgacttcattgagtaggttcttggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggcatgtttaagcgcacagtgctctcctgcccacccccagcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcggtaagtccctccggagaagggcactcacacccatacccagtcaaaccctccacgcggccatcccctccattgccttcctgcttcctccaactcatcctcatcccctctgtgacatacaggaacccccctccggcctcacccacatatttgaatgaattgcaccccttatcattccttttctcaaacccttcaggtatccattttccacagacatttcctccattatttcaactctccacattcctccctttcaacccatcattaacccattttccacctcagccatttccatctgtcactcatccccctccatcagtacctcattttctgtatcagccatctcccctccctgtacctcaacagtccccctcgccattttctccccatttttccttcctgcctctaccttaacatcctcctcattcttctccatcaaaggcagtgccatgccatggggctcctttgtcattccaacacgtggcctgtgggtaggggggaagggaaggagggaggaaagcagaaagagaaaaaggaggcagatcctgaaagagcttgccctgtgtctgcggaggcaagagatgtatgggcctagagcagctagcaggtgggtaccagggaggaagctggccgggtgtggaggtaatgcagggacaccaaaaggaggtgggtggttggtgagccgttccactggccctctgcctggaagctgctctcgttctctaggggcaccctcttggtgtgctagggttctttcccagtcccaggggaaagaaggtgtgggttgaggcagaaatggcagaccacccccccccgctccctctcagacggcttttgctgccatttccgaaaacggttgcccccccccccaacgaggtgctctttcttctctgcctctcccaaccccaccccccaccccatctcccccacagacgtgacatgctggtggggggcaatgggggagtacccgcctttgtggagccttttcttcgtcagagaaaggtgactcccagaaccatgagtcaacccagccacctgcagcagggcctgtgggggcagcagtgagggccattgtccctgcccacctagggccttgggcgcctcccccttacccggttacaggcctcactcctggaaggacaccctgtacacctccctgctgtgaagcagtcagaggcagaaaggcaggtctcagctgtggctgccagcctaggacattgctagaaagactctggttctcctggctttggcaggggttggccaagtctcagaagggctgagaatggcttctggccatcccccagagagctctagctacaggaaagtcccccttcccctgatatccaccacagacacaccgatagagggagactggaatggaagaattcgggttgtacgtttctcttataacaaatgctcctgcacccaccttaaaagggactcagaggaatatgggtctgatgatgggccggatcctaaaccacagggtggactgggggcgtagggtgaggctaggagaggtattaaggaaatggtggttggttagtgcccaattgtctcctaacagctggggttgaaaaagtcctgtccccaggatgcttttgttcactcacactggtgcttaggcggcacagccctcacagttttgtgtgtagacgctggcaaatgagtaaagggaactgttgccctggttgggggaaggatagtgtcgccccccctgctaatgagggagttggaaacagcagtttccaaaggctgtgagtcaccctgtgatctgagtcacacgtgaggcttagcatcgtcagaggggtgggggcggggaggcctggggtctccgatggcagacaggactccagacacccattccctgactcagtctggctggccaggacagctggcggaagacccaggcctgttcccggtcctgggccactgccccagctgccctcagcctgggcaccatgcctgaggcgtggcgtaggagaccacgatgctcaggtgacctcacccgttacactgaccttcgccagctcctgtgtgtgggtcgctcagtccatggtgccacctcgctcagcagggcctctcaggggtcctcagtctggcccaaggaccagggcctcagcctagccccaagagtgggccacaaccttcagcttcctgctgggaaaacccaggaggtgaggacggaatcacagaattctagaatgtcagagccagaagagatcatctagtccaaacctttcattttacagatggggggacgcaggcccacagaacaggcatgacctgctgaaggttacccagggagtcatttagggattgcaagatcatcaggaacagggctggggcagaagagaaggcatcaagtcttggccctgggtttctttcagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaata

SEQ ID NO: 4347 - DNA, 1638 bp, Homo sapiens
cgcggctgagcctctttgtctgagcgcgctcggcttttttttttttttctctctccttccctgcagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 4348 - DNA, 545 bp, Homo sapiens
caacggaccctacctcttgtagtgattctcggggccacgggcaccggcaaatccacgctggcgttgcagctaggccagcggctcggcggtgagatcgtcagcgctgactccatgcaggacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtg

SEQ ID NO: 4349 - DNA, 545 bp, Homo sapiens
acggcagtgaggtgaggctggtgagaggggaagtggcgacagttcagtcaactccctcaaaaccagtctggccttcaccaggcggagatgggtggggccgggaagacgggcgttgacgacagaaggctacttccggctgtgtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 4350 - DNA, 585 bp, Homo sapiens
gttttaaaagattataagtaaatactctgctctttcaagtgaaccaaacctatcaaacctgtttagaaaataaaccaggcagaataaaatgatgcgaaatgttcattttaaaaaacttcaggatgggcacaaacacacagaagtgggaaatgaataaaagagtattgataaatttttgaaaattgttgaagctgagtaatgggctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgatt

SEQ ID NO: 4351 - DNA, 2674 bp, Homo sapiens
agttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattct

SEQ ID NO: 4352 - DNA, 1701 bp, Homo sapiens
aacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagagagaagttctcattgtgggaatctgacatagttcagctgaggaagagaatcagctgatcctcatggtctgccacgtaatcattttcttagacgtttgctccaccagatttaaccaaatgtaact

SEQ ID NO: 4353 - DNA, 1980 bp, Homo sapiens
caacagaaacatgatgctgatgttcagaagattttagaaagaaagaataatgaaatagaagaactgaaaactttatacaggagtaaacaacatgaaactgaagagactattagaaagcttgaaaagaaagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataacgtgtagtgaattacaagaagtaaaggcaaggcgtaacacactgcataaagagaaggaccatcttgtaaatgattatgagcaaaacatgaaactgttacaaaccaaatatgatgctgatataaaccttctaaaacaagaacatgctctttcagcttctaaggcatctagtatgattgaagaattagagcagaatgtctgtcaattaaaacagcagttacaggaatcagaacttcaaagaaagcaacaactaagggatcaagaaaataagtttcagatggagaaaagtcatttaaaacacatctatgaaaaaaaggctcatgacttgcagagtgaacttgataaaggaaaagaagatactcaaaagaaaattcataaatttgaggaagctttgaaggaaaaagaggagcagctaactcgtgtgactgaagttcagaggttgcaggcccagcaggcagatgccgctctggaagagtttaagcggcaggtggaactgaactcagagaaagtctatgctgaaatgaaagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattc

SEQ ID NO: 4354 - DNA, 4737 bp, Homo sapiens
gtttgaagaaaaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactctttagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggtccaatccctagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcatggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttcctgcttgtttatcttatttattatagaaaaccatgataatggctttgcatagagaattaggagtttgtctaaggatataccagttggctgtcctaagaaacaaggagcattcattaccaaggagaatggactttgatcaaaggtctatcagcctcatccaggaactagatttttttaagggaagcagatctatttctgaaagtcagatttataataaagctcaaaaaactgagctataaacctgtaataccagcagactttcaataagagactcttacaactcaattgtggaaaaactaataattaaaaatgggcaaaggacctgagcagacatttctccaaagaagacataagaaatggccagtaggtatagatatgaaaaggtgttcagcatcattaatcataagaataatgtaaattaaaaccactgtgagctatcacctcacatctataagaatggctattaacaagacatgagataaatgttgatgagattgtggagaaaagagaaccctagtacactgtttgtgggcgtgtagactggggcagccgttatggaaaacggtatggaggctcctaaagaaattaaaaatagaactgttatctgaccctcttctgagtaagtatgtacccaaagaagatgaaatcaccagctgggcgcagtgactcacacctgtaatcccagcactttggagtgggtgaatcacctgaggtcaggagttcaagaccagcttgaccaacatggtgaaaccccgtctctactaaaaatacaaaaagtaggcgggcatggtgacgggcacctgtaatcccagctacttgggaggctgaggcagaagaatcacttgaactcgggaggtggaggttgcagtgagccaaaattgcgtcactgcactccagcctgggttacagagcaagactccatctcaaaaaaaaaaaagatgaaatcatcacctcataaagatatctgcactcacatgtttgtggcagtgttattctcaatagccaagatgtggaaacaacctaaatgcccatcaatggacaaataaagaaaatacggcatatgcatgccgtggaatagtattcatccttggaaaagagggagttcttgccatttgccacaacatagatggacctggagaacattatgctaagtgaaataagccagacccaaggaaaaatactgcatgatctcacatatggaatatttaattttttaagaaagagctcaagtacacagagaaagtgcttaccacagattggggaagaggaaatggggagatgcaggccaaggatacaaaatagcagataaaatgaacaagtctagagatagggctaaagttaatacaattgtattagggatttttgttaaataagtagattttagctgctattatcacaaaaaaactgagatgataatgttaatctgcttcactatagcagccattttattatctatatgtatcccataacatcatgttgtaaatcttaaatatacctaataaaataaaattgtcacc

SEQ ID NO: 4355 - DNA, 1092 bp, Homo sapiens
ggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggaagttctccagcagctgattgtaatgaatttgcccaatgttttgatgattggcagagacccactgtctgggaagagcatggaggaaatcaagaaggtgctgctgctggtgctgggctgtgctgtccagtgtgagaggaaagaggagttcattgaaagaatcaaacagctggacattgagacccaggctggcatcgtggcccatatccaggaggtgactcacaaccaagagaacgtgtttgacctgcagtggctggagctgcccgacgtggctccggaggagctggaggccctgtcgaggagcatggtgctccacctgcggaggctcatcgaccagcgggacgagtgcaccgagctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctgtgagtccccggctgcttctcctacctttgtgtgtgttgcagacatgtttctggtgtggtgtcgactcacatgtgtggtgctgccaatggcacagctctgacgtgtgccccggagtcagctggggtctgccctgagcttactctttgacctcggactagctgcctcccctccagacggtgcaagttgtccacagaagcagcctccagtccacgctcagctccagcttggggccgggacgaccacacctgatgtgttttcttggctggagggatgaggtgcccctccttccctccaatctggtgagcctgttctcccaggtttcctgcagctgatggatgtcacctgtggagcctg

SEQ ID NO: 4356 - DNA, 1894 bp, Homo sapiens
atcaaagacagcagacttttctgtgatccaacatttctgcctgagaatgattctcttttctacaaccgactgcttcctggaaaggtggtgtggaaacgtccccaggacatctgtgatgacccccatctgattgtgggcaacattagcaaccaccagctgacccaagggagactggggcacaagccaatggtttctgcattttcctgtttggctgttcaggagtctcattggacaaagacaattcccaaccataaggaacaggaatgggaccctcaaaaaacagaaaaatacgctgggatatttcactttcgtttctggcattttggagaatggactgaagtggtgattgatgacttgttgcccaccattaacggagatctggtcttctctttctccacttccatgaatgagttttggaatgctctgctggaaaaagcttatgcaaatctcccaatcaggaggagcaagaagttgaaactgattggggtctgctgaagggccatacctataccatgactgatattcgcaaaattcgtcttggagagagacttgtggaagtcttcagtgctgagaaggtgtatatggttcgcctgagaaaccccttgggaagacaggaatggagtggcccctggagtgaaatttctgaagagtggcagcaactgactgcatcagatcgcaagaacctggggcttgttatgtctgatgatggagagttttggatgagcttggaggacttttgccgcaactttcacaaactgaatgtctgccgcaatgtgaacaaccctatttttggccgaaaggagctggaatcggtgttgggatgctggactgtggatgatgatcccctgatgaaccgctcaggaggctgctataacaaccgtgataccttcctgcagaatccccagtacatcttcactgtgcctgaggatgggcacaaggtcattatgtcactgcagcagaaggacctgcgcacttaccgccgaatgggaagacctgacaattacatcattggctttgagctcttcaaggtggagatgaaccgcaaattccgcctccaccacctctacatccaggagcgtgctgggacttccacctatattgacacccgcacagtgtttctgagcaagtacctgaagaagggcaactatgtgcttgtcccaaccatgttccagcatggtcgcaccagcgagtttctcctgagaatcttctctgaagtgcctgtccagctcagggaactgactctggacatgcccaaaatgtcctgctggaacctggctcgtggctacccgaaagtagttactcagatcactgttcacagtgctgaggacctggagaagaagtatgccaatgaaactgtaaacccatatttggtcatcaaatgtggaaaggaggaagtccgttctcctgtccagaagaatacagttcatgccatttttgacacccaggccattttctacagaaggaccactgacattcctattatagtacaggtctggaacagccgaaaattctgtgatcagttcttggggcaggttactctggatgctgaccccagcgactgccgtgatctgaagtctctgtacctgcgtaagaagggtggtccaactgccaaagtcaagcaaggccacatcagcttcaaggttatttccagcgatgatctcactgagctctaaatctgcaatcccagagaatcctgacaaagcgtgccacccttttattttccgtcaggtgccaggtcttagttaagattcacaatctttagaaagaatgagattcacaataattaactcttcctctcttctgataaattccccatacctcccaatccaagtagcatctgtagctacataacctatatacctccagcagctggacatggggaggcgacagtcct

SEQ ID NO: 4357 - DNA, 1538 bp, Homo sapiens
cttcctttctcttcccattgtccccaggtccactgaaaagggcaagcaccctgtaaatgagtttccctcctgctcttgctgggtggaggagataggcagaggtttagcccttaaaaagacatggctaggatatccagccctagtggcctgagaatacagcaagatgacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaa

SEQ ID NO: 4358 - DNA, 1392 bp, Homo sapiens
gcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttggagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaagatttttttcttcatcttttgagattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctg

SEQ ID NO: 4359 - DNA, 2469 bp, Homo sapiens
gcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagcacgcccgcctctggtggccaccccgctgccccatggctggctgggtggccaggcaggaagtgcccagcccgagaggctgggaggtttgttga

SEQ ID NO: 4360 - DNA, 3253 bp, Homo sapiens
aaggaatgccagcagctaccagaaaccggaagggcaaggaatgcattctccccagagccttcagaggaagcatgactctgctaacaccatgattcacaattctggcctccaagaacagagagaataagcctctattgtttaaaccacctggtttgtcctaattcgttattgcagccacaggaaactaatacagaaggctaaaatgaaaacgatgaagaggtgcagtatattcaggctgagaaaaacaacaagggcccaatggaggctgccacactttttctcaagttcctgttggagctccaggaggaaggctggttccgtggctttttggatgccctagaccatgcagagctatggtgttttctatcaacagaagaatcatgaagttcataaatttggaaaggagagctttatttttcataaagggttgcagtctgcatggtggccattttgacaggctgggaagtgtagcctcgggccagaagcaggaaacaggcacttggagggtggggagagtaaaacagagatttatgctgaatagggtgaccaaatattcagtaagctacaggaggagtcatgaaagtagaagcatgcacctgggcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatatttttt

SEQ ID NO: 4361 - DNA, 1470 bp, Homo sapiens
gctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctg

SEQ ID NO: 4362 - DNA, 1371 bp, Homo sapiens
aaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactggctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgctt

SEQ ID NO: 4363 - DNA, 375 bp, Homo sapiens
atgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctcctgtgtctgtgcagtccccctgcggccagccgaccccttgcagcaccacctgcaggacctcctcctgctga

SEQ ID NO: 4364 - DNA, 2037 bp, Homo sapiens
atcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcaggtaatggagcaaggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagt

SEQ ID NO: 4365 - DNA, 5261 bp, Homo sapiens
cgagggccagcttggtggagcttagcacagcttgctcggcgctgcgagcgggcgggggtggacactgggcttctgtgtgccagtcgcagccgttggctggcgggcacccaatcccagggcatgccgccggagcctggccaggacgcacggtgaaagacgagtttggtggcaggcttgaccccccggctgccagcagaagccggcgtcgggagcccaggcgggcaggccgctggggtcggggctgcacgtacgagagccgggacgcccgggttcagagcgaaggaggaggcatggcttcggtgttcatgtgtggcgtggaggacctgctgttcagcggcagccgcttcgtatggaacttgaccgtgtccacgctgcggagatggtacacggagaggctgcgggcttgccaccaggtgctgcggacgtggtgcgggctgcaggacgtgtaccagatgacagaaggcaggcactgccaggtgcacctcctggatgataggagactggagctgctggttcagcccaaacttctagcaagagagttgctggacctagtggcttcacatttcaacctgaaagaaaaggagtattttggaataacattcatagatgacacaggtcagcagaactggctgcagttagatcaccgagttcttgaccacgatttgcccaagaaaccaggcccaaccattttgcactttgctgtgaggttttacattgagagcatatcgtttttaaaggataaaaccaccgtggagctgtttttcctgaatgcaaaggcctgtgtgcacaaggggcaaatcgaagtagagagcgaaaccatcttcaagttagcagcgtttattttacagtctcccaaagtctcgcttacccatgatgaaaatgccaggaaagatttaaagacattaccagcctttccaaccaaaactcttcaggagcatccatcccttgcctactgtgaggacagggtaattgagcattatttgaaaatcaaaggtctcactcgaggtcaagctgtggttcagtatatgaaaatagtagaagctctaccgacttacggtgtccattattatgcagtaaaggataagcaaggacttccttggtggcttggaataagctataagggaattggccaatatgatatacaagacaaggtgaagcctcggaagttattccaatggaaacagctggagaacttatatttccgtgagaaaaaatttgctgttgaagttcatgatccacgaaggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagcaaaaattccttcagccaggagtttagatgagattgcaatggatttgacagagacaggaacacaaagggcctccaagctggtgacactggagacgaaaagtcagttcatcatggcaagtaatggcagtttaatctcctcaggttctcaagactcagaagttagtgaagagcaaaagagagaaaaaatccttgaactaaagaagaaggagaaactattacaagaaaaacttctgaaaaaagttgaggagcttaagaagatctgtctgcgggaggctgagctcacaggcaaaatgccaaaggagtatcccctgaacataggcgagaagcctcctcaggtcagaagacgtgtgggtactgcgttcaaattagatgacaacttgctgccgagtgaagaagatcctgctttgcaagaactggagagtaattttctaatacaacaaaagctggtggaagctgcaaagaaacttgccaatgagccagacctttgtaaaactgtgaagaaaaagcgaaagcaagattacacagatgcgatgaaaaagcttcaggagattgaaaatgcaataaacgaataccgaattaggtgtggaaagaaacccagccagaaagcaacagtgttaccagaagacataatcccctcagagagtagctctttgtctgacaccaccacctatgatgatcccagtgatgccttcacttttcctgggcagcgatcaagttcagtacctcattctccaagaattcttccccccaagtctcttggtattgagcgaatccatttcagaaagtcgtccatcaatgaacagtttgtggataccaggcagtccagagaaatgctgtccacacacagcagcccttacaaaactctggagaggcggccccagggaggacgaagcatgcccaccacgccagttcttacccgaaacgcctacagcagcagccacttggaacccgaatcttcatctcagcactgccgccagcggagtggaagcctggagtcccagtcccacctgctctccgagatggacagcgataagccatttttctccctctccaaatcccaaagaagcagcagcacagaaatcctcgatgacgggtcttcttatacaagccaatcaagcacagagtattactgtgtgacaccagttaccggcccctattacaccacccagaccctggacactcgcaccaggggtcggaggaggtcaaagaaacagaatgtttctacttcaaattcaggaagcatgcccaacctagcacaaaaggatagtttgaggaatggtgtttactcaaagagtcaggagccaccgtcttccagttactacattgccgggtacacaccctatgcagagtgtgacttttattacagtggtggttatgtctatgagaatgacaccgagggacagtatagtgtcaacccttcctaccggtcctcagcccactatggatatgagcgccagagggactacagcagatcctttcacgaagatgaggtcgaccgggtaccccataacccatatgcaactctccggctgccaaggaaggctgctgcaaaatcggagcacatcaccaaaaacatccacaaggccttagttgccgagcacttgcgtggctggtaccagcgggcctctgggcagaaggatcagggacacagcccgcagaccagctttgactcagacaggggatcacagagatgcctggggtttgcggggctgcaagtaccttgttctccaagcagtcgtgcatcctcgtactcttcagtgtcttctacaaatgcttctgggaactggaggacccagttaaccatagggctgtcggattacgagactccagcacattcttcttacaccagctgctatggcaatgtctataatcctttaccctctccaagcagacaatacacagaaatcagtcaactggatggtacagatggaaaccagctggaagacaacctggagagtagtgagcagagactcttttggcatgaagattcaaagcctggaacattagtctgaactgcagttggacctcctgaccaagcactgcgttctcacactagtgtgccttgcaaattgtatttgtcttccgagaggatgttcgttttagaaacctaaagacatcaaaggttgaagagaagacttagttgccctggaagtgaatcagtgaatcacacaccaagccccacaaagcccctaaaggaggatttggcctttcaaactctaggcactaacgtaactgtagggtctgcccacatgttgaagtattgccaagagaggactcagtgtgaagccttcatcaatagcaagcactttttaagggagtaaaagttgttaaaggcaaacctcaaaaacatgaaagggcattcaggatgtcccatggcaataagaacaggggaaatctcagagcacaattcagcaggatgagagaaggggaaccagaagctccggagtcattgctcacttcagagtttgaattcgtgagctgacaaagagtaacatgctctttctacacagacatggacaatttagacagtattggaaaattacttgaagctggattttcatgaagttctgaatgagtgtaaatgttttttaggatactataaagagtgatgtttttcataagcaccataaaatgggttctggaaaaactgattaccttagcatcctgtaatataacttatggtagcagattggggaaaatgaagcagcccactgaataattgacaaagtctgcttggagaacattctaaggtacaatatcatggagctcctttttcctttctccactaattgcgtgatgagctattgttctggctgttaattctccaactcggctgtcatttgaagtggcagacttaatatggaaagtttttataattatgagtttgaaaaagcattttaagatgatacagaaagtatccaaaacaacagaaaaaaaaagccacgtcattttagatgaattgcgtgccttaaaatggtgaacgttagaaaattaaacaagtctggattccacaagtagttccaagtcaccaagtgacaaaaacaaggttaacattaaaaaagaaaaacaacaacaacgacaaaaagctccaagctgcagtggatttaattatgaggctaaaactacctcatactttccttggaagaactaattagctatggtttattgtagggttttgtttgtttgttttttaaagcaaatgatttccatattccagattgatcttttttgtcatctttgcttcaaaattacataaaaggtgctcctttcccccttcttttatacaagtttcttgttcatattgtgaatagaaaagtttctgaacaacttttttggaacattttctatctatattccaaagcatgtaatatatacataaaaacgatttgttaaactggtccttagtcatttgtataattagaaatgaagtttgggaaaaaattttggaaaaaagacaagcaaaaaaaaataacttattccttttttgcatatttgtatagccttctagaatcagaaataacctttttgcatattcttttattgttctgacttttcaagacctattatttttttacataggtcaataaacaaaaggtgtgctactgaaaatgtttacgttttcttccatttatgtcaggggttcatgtgaagcaggtcgcagtgctctacttcaagtaatcatattgggcaaggcttcggatttttatttatagtattaccgtattttattaattccgggatgtacatttttaaatatttacattaaaaacatggttcatctttttattgatggcatattctacttgaattggcagttttttcttaatagtacattaaaaataatgctgtgtcttacaataaagttgccttagaattga

SEQ ID NO: 4366 - DNA, 3868 bp, Homo sapiens
gcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccg

SEQ ID NO: 4367 - DNA, 4384 bp, Homo sapiens
atgcttaccgtccaagtgaagacttcctctgccatagaacttccagattccttggcattcctgtggatcatcccaatgtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaggcctgtctgcatggagcatatagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaatg

SEQ ID NO: 4368 - DNA, 69 bp, Homo sapiens
gtgaggctggcttggggcttcgtctcggctctgggctccttccacacggctgaccctgaaggagcagcc

SEQ ID NO: 4369 - DNA, 2273 bp, Homo sapiens
acacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggtggtcactaactgccaagagagaatccagcattggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctc

SEQ ID NO: 4370 - DNA, 1865 bp, Homo sapiens
aacaagttaagctgaagaccgaagcaagagctggttcagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccaca

SEQ ID NO: 4371 - DNA, 2391 bp, Homo sapiens
ccgcagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatgtagttattcctctggaccatgaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaaaaa

SEQ ID NO: 4372 - DNA, 2437 bp, Homo sapiens
atgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatac

SEQ ID NO: 4373 - DNA, 1959 bp, Homo sapiens
cccctcaggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacagcatttagaatgctttcatctagctgcagttttggtgaatttacttcagcttttcctcttcaggctacccacagtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttg

SEQ ID NO: 4374 - DNA, 3403 bp, Homo sapiens
aggaatggttttagggaagactgttgccggatgacaaggctgtcactattgttctgtactacctgacattatgggaccaggccagccagcttcaacctgtgttcatctagcacctaggacccaacttgatgggaggagcgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaaggtaaaagaaatccaggaagaattggataaattgagtccacataaaattaaacacactaagaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctct

SEQ ID NO: 4375 - DNA, 3700 bp, Homo sapiens
cagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaa

SEQ ID NO: 4376 - DNA, 3495 bp, Homo sapiens
ctccccgaactgcggcggcggcgagcgccggccgcatctgagcagagctgcagcggcggccgcgggcaccagagtgccgagcccaggacgcccccggcccaggcccttgggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtacccaga

SEQ ID NO: 4377 - DNA, 2381 bp, Homo sapiens
aaagtctgtatactttttggttgggcagatctccaccggccctcaatctgattggccctcgagctgtggatgtgctgtctgagttgtcctatgcccctatgactccagaccacttcccaagcctcttttgcaagtggcaaccacagctgagtgaaacaaactgtaaccgaatgaaagcaatgacaacggaatcctccccaggaagctgctgattagagagggccaaacggacagacatcttggccacctgtaacgagcaacttccaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagac

SEQ ID NO: 4378 - DNA, 1862 bp, Homo sapiens
acttctcttcttccgcgaccgggagaaggccgagggatcggcggcacgatcgacattgtacaccttgaaggtggacggatgtgaagccgcgcgttgtagggctgaagcttaccaaagaaaggaagaatgcacttttcaggattagaagaggctgtgtatagaaacatacaagcttgcaaggagcttgcccaaaccactcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtc

SEQ ID NO: 4379 - DNA, 3110 bp, Homo sapiens
acgtcgttgggacatcgctgggaccccgggctctgcagccacaaccatgtttggccggaagcgcagtgtctcctttgggggcttcggatggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggggatcaagcttgaagagcagaagccgggaccccagaagaacaaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccccttccgagtctgcagcgcc

SEQ ID NO: 4380 - DNA, 2288 bp, Homo sapiens
agttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggactt

SEQ ID NO: 4381 - DNA, 1504 bp, Homo sapiens
acattcccacaggaaacaagtcgaccttctgtagcaaagcagcttcttgccgggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccatttgtgtcacactggagaagggatggcaccaccctttgttttggcccacaggaaattttcatcctcagctgt

SEQ ID NO: 4382 - DNA, 1165 bp, Homo sapiens
agccaagggaaccacatggaagttgtgacagctcccagcggcgcgcccctttcgtgtgtgccggtacctcggcttaggagttgcccgctgacaccttgaatgaaggaggtccccttgccagccagcctgccgggatgggccattgctgctgcaagccttataactgccttcagtgcctggacaagacgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccac

SEQ ID NO: 4383 - DNA, 1481 bp, Homo sapiens
agctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaacctgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgcctt

SEQ ID NO: 4384 - DNA, 5541 bp, Homo sapiens
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaagaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagaatcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 4385 - DNA, 911 bp, Homo sapiens
tagttattaaagttcctatgcagctccgcctcgcgtccggcctcatttcctcggaaaatccctgctttccccgctcgccacgccctcctcctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaatcaaaaaaaaaaaaaaaaaaaaa

SEQ ID NO: 4386 - DNA, 3576 bp, Homo sapiens
aagtgctcagcaacgattacgccccgagggccaatcacagggctgcggccgagaaagaagccttaatagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatgaa

SEQ ID NO: 4387 - DNA, 643 bp, Homo sapiens
agtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttaacaagagatctcttgaattgttccttcaagtgtagctatgttgtaactaatggccttgggattaacgtcttcaaggacccggttgctgatcccaacaaaaggtccaaaaagggccgattatctttacataggacgccagcagggaattttgttacactggaagaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgttgtatgtaatacataatgtttattgtacagatgtgtggg

SEQ ID NO: 4388 - DNA, 1735 bp, Homo sapiens
cccctttcataaaagcacagacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccga

SEQ ID NO: 4389 - DNA, 4344 bp, Homo sapiens
ggcggcggcggcggtgcctgggcggcagcagcagcagtagcggcagccctgaggacgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaaga

SEQ ID NO: 4390 - DNA, 2130 bp, Homo sapiens
agccaggggagaagatttcttacttctgtgacacaattaaaatggataggtacccactctgaagtgtattctgcgacagtagaaaaggggatcaaggagaaacttcaattaatgaaaaatatgctttcggaattttttttttgacagatcgctttaaatatcatatcgttaagcagatcttctctggaggagaccagacttttgtactttgctccaaatacgagaattgatgaacattttaaaacgagtcccaaaatccctgggattgacctgaactcaactagggtgttatttgagaagttaatgaactctcagcactccatgattctagaacagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttg

SEQ ID NO: 4391 - DNA, 2692 bp, Homo sapiens
agtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggaggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcagttcagccagatccggagagcgtggttcttggcacggatggagggcgctacgatgtttacctctatgaccgaataaggaaggctgcctactgggaagaggagccagccgaagtgagacgctgtacttggttttacaagggggacacagatagtcgatttattccctatactgaggagttcagtgaaaaactagaggctgaatataaaaaagctgtaaccactaatcagtggcaccgaagattagagtttccaagtggagagacaattgttatgcacaatccaaaggttattgttcagttccagccctcctcagtgccagatgaatggggcaccacgcaagatggacagacaaggcccagggttgtaaagcgtggaattgatgataaccttgatgaaattcccgacggggagatgcctcaagttgaccatttggtgtttgtggtgcatggcattggacctgtgtgtgacttacgctttaggagcattattgagtgtgtggatgattttagggtggtttctctcaaattgctgcggacacatttcaagaaatctttagatgacgggaaagtaagcagagtggagttccttccagttcattggcatagttctttgggtggggacgccacaggtgtggacaggaatattaagaaaatcactttgccaagtattggtcgatttcgtcactttaccaatgaaactttgctagatattttattttataacagccccacctactgtcagacaattgtggaaaaagtaggaatggagataaaccatctgcatgcactctttatgagtcggaacccagacttcaaaggaggtgtctctgttgctggtcacagtttaggttctttaatattgtttgacatcctgtctaatcaaaaagatttgaatttatcaaagtgccctggacctcttgctgttgctaatggagttgtgaagcagctacattttcaggaaaagcagatgcctgaagagccaaagctgactttggatgagtcgtatgaccttgttgttgaaaataaagaagtcctaactttgcaagaaactctggaagcacttagcctctctgaatattttagcacttttgaaaaggaaaagattgatatggagtccctgcttatgtgtacagttgatgacctgaaggaaatggggataccccttggacccagaaagaagatagctaactttgtagaacataaagcagccaaactgaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtttctgttgcttacaactcattagattttgaaccagagatattctttgccttggggtctccaattgctatgtttctcactattcgaggagttgataggatagatgagaattacagccttcctacctgtaaagggttcttcaatatttatcatccgcttgatccagtggcatatagattagaacctatgattgttccagatttggacctaaaagctgttctcattccacatcacaaaggcagaaaaagacttcatttagaattgaaagagagtctctctcgtatgggatctgatttgaagcagggttttattagctctctcaaaagtgcttggcagacattaaatgagtttgcccgtgctcatacgtcttcaacccagttgcaagaagaattggagaaggtggccaatcagatcaaagaagaagaagaaaagcaagtagttgaagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattgggaatctgaagatactgctctgttactacttaaagaaatttatcgaacaatgaacattagtccagaacagccccagcattgatcaaacttcagttttactgtactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaa

SEQ ID NO: 4392 - DNA, 2127 bp, Homo sapiens
aggtacccagtgcagtcctgatctccagctctccagcggcttagaacagacacagaatgggccgggaccagggacccaccagagacgtctgtagttaatagctggcgctcttccactaataaagttttattgaaataaagcatttaaaaaggcgcccgtcattcttcccccagcgaccaatcgaagagtagaatgcctgcgtccctcactggagcttcagcggtcggaacgcgggggtggggcatgtcctgccgaaatttgcgtccttagagcggaagtacggccggaagcccgccatagagtttagtggccagagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatct

SEQ ID NO: 4393 - DNA, 576 bp, Homo sapiens
agttccctgctcctccctctctgagcacggagcagaatctgttctgctgaagctgctgttccactttttagcttgctatatttgtacagcaacagcaggagcagcccactagctaggccgtgtggccaccctttggcacccgcaccggctcagacctgctcaggactcagccagggcacacagtttgtgttcttacgtgcatccatctgtctgtctgtgtgcgtctctgtggaggactgaggttttcaagtgaaagaggctgaacataacttctttttttcaaagttccctgtgttgtgaactgagcttgggtgaagtgaaatctttgagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctct

SEQ ID NO: 4394 - DNA, 2319 bp, Homo sapiens
agaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaagtaagtactttttgctttaatgtgtcagtagtttttgttatttcccttcaaactgataaaaatgtacagtgaatccgaaagatttaaactactggtacaaatattttaatcttattggctcgggtttaaactaaaaatatcctcttcctgcacaccaacaaaaactggaagaaaatatggattgagtaccaatatctagagtttgttttaatatgtgggggagaggaaatatactatgttaatttcaagcgtaaaaatagggctgcaagtaaacagatatgttccttgaaatgtaaaatttcgcccgtcactgatttcaggctttttcaaactgctgatgctgtgtacaggagggggaggaggaaaggttcgagacctttgaaggacatcgtgtagcgctgtaacctgaggggccgccttggttttgtgggtgctcctacgtcactaggctgtgattttggggaaatggggccctccaccttatgtagatccagagtccgtggctctgagcatcctccctttcccactggacctgcctgcagtgtctgccttgggaatggtcaagacagagatggtatcgtgcagcctctggtctccacacagtgagagtccagggctcagggctgctcaagaccaaggcttcccttgatgcttcacttcgggtgatcagacatgggggacctgtttatctttagtagccggcaaaggcaatcgtaaaacatttgttgtaacttcaggattgtcactctaagaacaccttaatccacaatttgctctgctctcctctttgcagaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggc

SEQ ID NO: 4395 - DNA, 548 bp, Homo sapiens
attgtatgtgaattagccacccttgtgactatttgaggagagagaagttagtctaaaatattatgttaaattatgatattacataattttattgcataagttcatcaaactacttccatctgaaaaatcctgatctcaaaatagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 4396 - DNA, 4729 bp, Homo sapiens
aagcactttcgcgccgtatccctccgccccccttcccgacaccctcgcggcgagcggttcttgccgcatcctgcgcagcccctgcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaaggaggcagccggtccagagagactttctcaaagcccagctgtcccacctagcattcaacatcagtcgcactgcatacgtctcatacaattggaagagactcaaagcctcatttcattctctctccctagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggcataagtgacccttcttcagtttaagaaccatgtacagataaatcgtgtgcacttacaaacataggtaattattagtatgacaaacatgcgcttattagaaaattctgttcttgagttaagaagggagagattattgtgggccctgatacttgaggaatgtttccgagaagagggacccacttaaattggtcaggatagaacaaattggtcaggataggagagcaagacaacttgcccgcctgcttgcccaattatgagccttcccaacaagcaacctaaaattaatacttcttataggacccatttaaattaccatcttagccctgggatttgcctaagggtaggataagacaaatcattaggttgctcttggaagtgggcagtggtggtttgaagaaaagtgtgtaattgaataatctgttctagtagcatggatgaacccagtctgcttgaaacaagtaaaaggagtttgatgagaaatgcagttagaaagttgggaagaggccaatttggggaacagaataagccaaatctgcatatttaacaattcaaagtacaggtgttacttcaatgccacctaaaggctgaaagagtaggatagcacaattaaatggagtggggaatatgatttcctttatattcctagacaaaggaaagtgttaaggaaataccatgcagccgttggaatgattatgtatggataggtttattgacacaaaaggacattaattattttatatttggtgaaacagagaatgtgacatcatgtatggaaaattagattccatttttaaaacatctgtaaatgtacacaattcctatgcaatttcaatatgaatttctaaacacagtctggaataaaatatataccttgttaaaaaatgcttagagacaggcgttggggagatacaaacattaataagacaaattaaaaaattaatatgctt

SEQ ID NO: 4397 - DNA, 2010 bp, Homo sapiens
cgggcgggcaggcgggcaggccggcaggcgggtgcgcggagggctggtgccccgcagcaggtgggcggggtgcggttggcggcggcggctgggccgggggctgccggctgcgctcgggccgtgcgcggcggccgtgcgggcacgccatggacttcaacatgaagaagctggcgtcggacgcgggcatcttcttcacccgggcggtgcagttcacggaggagaaatttggccaggctgagaagactgagcttgatgcccactttgaaaaccttctggcccgggcagacagcaccaagaactggacagagaagatcttgaggcagacagaggtgctgctgcagcccaaccccagtgcccgagtggaggagttcctgtatgagaagctggacaggaaggtcccctcaagggtcaccaacggggagctgctggctcagtacatggcagacgcggccagtgagctggggccgaccaccccctatgggaagacactgatcaaggtggcagaagctgaaaagcaactgggagccgcggagagggattttatccacacggcctccatcagcttcctcacacccttgcgcaacttcctggagggggactggaagaccatctcgaaggagaggcggctcctccaaaaccggcgtctggacttggatgcctgcaaagcgaggctgaagaaggccaaggctgcagaagccaaagccacggccgagggtcccacggtgcctgactttcaggagactagacctcgtaattacattctctcggccagcgcctccgcgctctggaatgatgaagtggacaaggccgagcaggagctccgcgtggcccagacagagtttgaccggcaagcagaagtgacccgtctcttgctggagggaatcagtagcactcacgtgaaccacctgcgctgcctccacgagttcgtcaagtctcagacaacctactacgcacagtgctaccgccacatgctggacttgcagaagcagctgggcagctcccagggtgccatatttcccggcaccttcgtgggcaccacagagcccgcctccccacccctgagcagcacctcacccaccactgctgcggccactatgcctgtggtgccctctgtggccagcctggcccctccgggggaggcctcgctctgcctggaagaggtggccccccctgccagtgggacccgcaaagctcgggtgctctatgactacgaggcagccgacagcagtgagctggccctgctggctgatgagctcatcactgtctacagcctgcctggcatggaccctgactggctcattggcgagagaggcaacaagaagggcaaggtccctgtcacctacttggaactgctcagctaggcaggtgcccccatcccccccgcattctggcctaggcaggagaggatgggcgcagccctgccacttaacttgtttgttggtgacacagttgttcagagtggggagaattcaccccattctgtccctgcccctagtcacctagctgtgagggtgcctgaggctgaatggctccacccctcccccagccctgcttctgacctgtggctctggagcccctgcccctgcctgcatccccgagcaccccaccctccaggctccactaaggagggaggggctgtctgcagcagctgcactcagcacctaggccagggtggggccgccgcagatgggctcaggaagccccaggtgcactcagcgagagccctgcctttcagttgccaaaagctgcatcaggggaatgcggcaaggcacacagggctctggcagcccctggggactgggcgctgcccctgggaggggagagcctggccagggctggtgttgggcccggagcagcatcttccggtgctatcctcccctcccacccctcacagctcaagccaagtccagcggccgcagtcttcacctctccacactcactttttatctggtgtttttacttctgcctgcgtttgctctctagccaataaaccgtccttgtgtgcgagtc

SEQ ID NO: 4398 - DNA, 495 bp, Homo sapiens
atgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctga

SEQ ID NO: 4399 - DNA, 1889 bp, Homo sapiens
gtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggagttccaggaagcgctcgcccctggccgaggatatgtccttgcaaaacacgagccctcctagtgaagaggggatgtcacccaaagcctaccaccggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatctaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgaca

SEQ ID NO: 4400 - DNA, 1146 bp, Homo sapiens
aaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggaagaagttcgtgctcaaaattaa

SEQ ID NO: 4401 - DNA, 1616 bp, Homo sapiens
agcgaggacttctaccgctgcggctactgcaagaacgagtcgggcagccgctccaatggcatgtgggcacattccatgacagtacaggattatcaggatctcatagaccgaggatggcgaagaagtggaaaatatgtgtacaaacctgtcatgaatcaaacatgttgtcctcagtacacaataagatgagcccatggattccacaatggatgatgctgttgcgggtgactttgcattgataaataaactggatatacagtgtgatcttaaaacactcagtgatgacatcaaagagagtttagagagtgaaggaaaaaattcaaagaaagaagaacctcaggaattacttcagtcacaagatttcgtaggagagaagttgggctctggtgaaccgtcacattcagttaaagttcacacagttcctaagccaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtgagggtggtgagatcatctccaccaagttcgcagttcaaagccacacttctggagtcttaccaggtctataaacgttaccagatggttattcacaagaacccacctgatacgccaaccgaaagccagttcacaagattcctttgcagttcacccttggaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacgagaaattgcttttactaggcagcttcatgagaaaacttctcaactcagctattattatatgggtttctacattcattcatgtcccaagatgaaatataagggtcagtatagaccttctgatttgctgtgccctgagacatatgtttgggtacccattgagcaatgcctgccttcacttgaaaactccaagtactgccgtttcaaccaggacccagaagcagtggatgaggatcgcagtacggaacctgaccgattgcaggtgtttcacaagagagccatcatgccttacggtgtttataagaaacagcagaaagacccaagtgaggaggctgctgttctgcagtacgccagcctggtggggcagaagtgctccgagcggatgctgctgttcagaaactgacctgttcacctctgccgggaagttcctgtgttgtgctgatgatttgtgccaggatacatattcagtacctgtggggaaataactgtcaccacccacaaattagacattttttattttgactatctatggcttttaaaaaatattttgtggcaatgtatctgtgagaatctcatagttaatataaagattttaaaactgcattatgacctag

SEQ ID NO: 4402 - DNA, 1047 bp, Homo sapiens
ggcccggcgcgccgcggccgcgcgaggcccccgccgtcgccgacgcccgagcgccggagccccggccccgccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgttgctcttgttgcccaggctggagtgcaatggcatga

SEQ ID NO: 4403 - DNA, 563 bp, Homo sapiens
aacgcacacttaaggctccagcaaagtaagtgccaaaaaggggagaatgggaagaatatgctgtatttcacaaaaagcatctaagtagccatctggaaaagccagaatgaacttcaatggtgcatccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtcc

SEQ ID NO: 4404 - DNA, 1362 bp, Homo sapiens
ttcttctcttccccggcagcacagtgtggctgtttgtctccttgcccgccaaagttctgcccagtccaacgactccacgcagctcgcccttggttatttggacaagaggcacattgacccaatttggagacgtattttggaaggaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcagggagctagaagacaagaaaaagattcagaatctcttggctcttgtgggaacagatgctggagaagtgacctatttttgtaaggagcctcctcacaaagtcaccattctccaaaagactatccaggctgtaggtgaatgtgagcagagtgaatcttcagctttcaaagcagatcctaaaataagcaaaagaagaccatcgagagagagaaaagaaagttctgagcattaccaaagagacatacagacactcatcctacaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaatcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaagtccctaaaagataagttagtacaagagaaaaagctgtccaatatgtaccaagagcagtgcatttccttagaagaagaacttgcccgaattcgtgaggaagagggaatgaggagagagatcttcaaggatcgcactaacaagatggggaagcgtttacagataatgacaaaacgctatgaggcattggagcgtcgacgtatcctggaagtagaa

SEQ ID NO: 4405 - DNA, 1976 bp, Homo sapiens
agtcacctgtgctgagccatcatggagagtgagggcctgtaagggtggacacagtatgcaggagggacaaatcttcctcaccggacaggtggggatccctgcggtgcactaggggaatgcacacagggggcactatgacctggcggcccacggggcacggggacgcaccaggtagccttgggatctgcaagtccctcccggaccctggggagtgccatgacggcttccagcagcagtcactgtcctgggcgcgtcccgcgctctagcccaggtgggtcccacaacggtgtgaccaaggacgtcctatgaccaccccttgacagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaaca

SEQ ID NO: 4406 - DNA, 1918 bp, Homo sapiens
gcaacaagttaagctgaagaccgaagcaagagctggttcaggtggcagccacagcagcctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaa

SEQ ID NO: 4407 - DNA, 5437 bp, Homo sapiens
attatcttctggcctctggagaaagatagagtagctcgctgattggatcctgaggttgaaataactccacatctcactgcgctccgactagagcaacgagaagagtgtctggaatggttgggagacattttaagcaggacaaatccagccttaggctagactgcacctgtccacagcccagcccaggcccatggaaaagaatagtaaaacctttgtctttaagcacatagaatatgtgtgaaacccagaaggctagaaaagaaagggaagtggaggagaaaaggcactgggactccagctgggagtatgaagactacgggagtgtacggaaaaggaaccttacagtgctggatggactctacagagaaaatgacttggatcccaggtactgggccaagggacagcatcagccctacagaaaaagggattgtggatactgggattttgaacagagtgaaccaagctatatggactgtggggaagcacatgaaagtggaaagggctgtgtgtaccacggaggtcatgatggttataggagtccagaaaatgtagattatgagagtctcagccctgggacgaaggataattcacctacgagaagcccagatgtgacctcgaaagctggtggatacggggaggcaaatggctactcagactgtaagaatctgaattataatcctgaggactctaaaaaagctgaacagttgactgactgtaggggtttggatgattcttcagcgaatttaggtcaacctcagttgtggtatatagaccatgagaatgttaaccataatcttgaggattgttgggcaactaatttttattgtagagaacacagcaatttatatcatgttcctgggagttatcctgatggtcagcctgtgagcttttcagattcgaatggtgtcaatgaagataaggaatttatcaaataccatgaaggggacaggaatgttcatcaaaatgacaacatgtatcccaaagcaaagactcatattatggatcagggtgattttgatacagaaaataaaggctatgatgctttatttgcaaactgtgcatataaatctcgtaattccagagggacagattctctccatcaaatggagaatttggagtataatggcactgacataccaagaacaaaggcacatgggggcagcaggatccttctggatggtctgcagactcagtgtaccaggggagaacaaggaggacatcatttggggattcctcagagctcgtcattagagaagaacatctggcatttagaggaagagaaaaaattaaatggcccagagacttggagaaggaatagttgcctccgccgcacagcacccagcaccctgaggcgctcagagttcgtgcaaaacagcaagaaaacccaagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 4408 - DNA, 636 bp, Homo sapiens
agacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagactttcaggattaagcatttcctggccaagaaacaaaagcaaaatcgtcccattccccagtggattcggatgaaaactggtaatacaatcaggtacaactccaaaaggagacaatggagaagaa

SEQ ID NO: 4409 - DNA, 1399 bp, Homo sapiens
cacaacgttcccgtttgcttatagttgtcaacgaccatgatctctggacccacactacagtaacaagtttgtcagtcattttcagataaggtgcaaatcaagggatggctttgtccccacttcggcgcaggtgggacagacttggggaagacgcagctgaagagacaaattctcaggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaaaactttcggtgtctgaactgctcagcttcgcaagtctgctctcaggatggccctttgtatcagtcataccctatggtactgcagtatcgaccaagaattgatttcggttagaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgc

SEQ ID NO: 4410 - DNA, 2870 bp, Homo sapiens
ggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggttaaaattgcagagttttctcgtactccagaagactttctaaagaaatatgatgaactgaaatctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctccatgcaggagcttgaggaactgaggaagcagcttggcagcgtggccacaggctccacgctgcagcagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgatagttcttttgagatggaatctcgctctgtcgcccaggctgaagtgcagtggcgtgatctcggcacactgcaacctccacctcccaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggttcattgaagagaagtcttccttcgagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgcgcaccatggacatcctggcctccctcgccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggaaagccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcagaaatttacacagagcatgaaattagatggcgagctgggcgggcagacgctggagcacagcaccgtcctggggctgcccgcaggggccgaggagcgggcccggaaggagctcgccaggaagcacctggctgagcacgcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcag

SEQ ID NO: 4411 - DNA, 2902 bp, Homo sapiens
attcctgccctggtggagcttacattatagaagggaggtccagaccatcaataaatatacagcgaagctccaaggaaaaacagagcagggcaaagagaagacagctatgggaggtggtttattttatataaattagccagacagtgcctctgagaggtgatgtctaagcagggactcggagatgagggaataagctaatggatatctgaagaaagaaccttccacatggatgaagcatcgcatgcaaagctcaaggaaggagcatgtttagtcaagtgcctaaagtggctggagcagagtgagtgagagttgagaggtagaagatgaattcggagagggagcattggggccagactatgtagcctagtgggccaagtgaggtcaggcctttaagaaggagcgtattgaggaagaaccatgcacactactgctagtgctagggtgagaaagatgaggactgagaactgacctggatttgggatcttgggtgaatgagtgacatccgcaagagtagtctctgttgactggttagggacagatgtctgattaactgggagcacaggaagctggggcagtgactctaggtaacacgctcttgaggcattggtatatgtaaagggtcacaatggaaaggaaagctagcaggagggcaagggaattagggttttgtttttgtgtttatttttggtgctgggataaacagcgtatgtgtcactgggtagaaatgatccagtaaaggaaaaattgtgaactttgttctctcttaatatgtgtgtttcgttgattcattcctgacttgtatctcccacatcttatcccttaattaagccattcttcctcttgcataattgcaaattattatgatataaatagctttgttgtactcttttatgagttttacagggaggaaattgcataaactctctataaagtaatttctatgtttaaaagcccttaagttctcccgccccatagcctgaccaaaaaagtcttactaaacaaaaataggatacaaatgatccatacacatcatcctggctagagaagggtcagaaactacagtgttgttagaaccaatagagcttaactttatatctcactggctttaataaaaaacttttctgagctatttgacacaaaaatcactaagattaagaaaatatcttaacacaggtggaaatagtaaaaggatgtttgcatgaaaaccgtcaaatgtaataaacagcactattctctgataataaaagatgaatctggctgtcagatgcaattttataatagcttcgaccatcatgtacggcaggagtatttttttttatttactatcgttaagtttgtggaaccagtgattgttgttttactattttgttaaggaaacctaaaacattcttagaatgtacagaaagaatatggtcattcttataggaccaaagggcgtatcaagtgagctgcttttgtaaataccatgaaaatccaagtctgacatggaattaaaatcatctctactacaagatgcagaaaaaaaccaaactcttttttttctatatcagagacttaaaaatattagtgatgaccaatgtgattagaagctttaaaatcctaacatttatgtgaacaaaaatcttcctgttttcagagacttaagcatatcatctgagcattgaaaaaagctcttaatagtacctttcagatttctcatctgttttcagatcccatattaaactccttgtggaagaatgagaaagaaagctactctaaattttacagaatagaattcaggctctttatttacaaaatggagtgtgaaccttgctgtttactcatctaccccctcaagcaattgtgttttccttccttatcagcacagaccatcacagttccaggatttgtctgagatgctagccacctctgattgctattcactggacactcttgtgattgtgatttaagattgtaggccaggcatgagccaccgcgcccagccggcatgtaaatttttatgtgacactttttttttggtggggggtggcaggggagagggtctcactgttgcccaggctagagtgcagaggtgctgatcacagctcactgcagggcacgcaccaccatgcccggctaagtttttgtattttttgtggagtcagggtctcactctgttgcccatgctggtctggaactcctgggctcaagcaattcacccgccttggcatcccaaagtgctgggattgcaggcatgagctactccgccctggctgtgatactctttaattattctaatgcttctaacttacgtcatggtgccaatcctatttatataatagaatcaatctcatactctcagctgacaatgaggggtatttcattttttacttgtatataagattccttttatataggatgaaatgcatacacactctgcatagaaattcttatgtgtttgtatattactccattcaatcatactatgattccaagttaagaactcctagataaattagcgtctgtagctgtaacagttgaggctttcaattcaaatgtcagataacattcttctgtgtattgtattattttctgcagtaattcaaatctttattgagttgaggtttgctcacttactataaggtagaatgaggtgatctaagtaggttttgtttaaatacatgtgtcttctccccatcagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctct

SEQ ID NO: 4412 - DNA, 2704 bp, Homo sapiens
gcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgaggagcaagcttctagcagcagaaaccgaactgctctgtcttctgtattgagagccatctgcagagctgttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtag

SEQ ID NO: 4413 - DNA, 5219 bp, Homo sapiens
acgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctc

SEQ ID NO: 4414 - DNA, 1685 bp, Homo sapiens
cgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaagaaagaaagaaagaaa

SEQ ID NO: 4415 - DNA, 2676 bp, Homo sapiens
acgcgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 4416 - DNA, 1672 bp, Homo sapiens
atcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaaaaaaaaaaaaaaaaaaaaaaaaaa

SEQ ID NO: 4417 - DNA, 1892 bp, Homo sapiens
agtttcgggtggcccagccaactttcatgccagccgtcctcagcccttcctggtgctgggtctgccaggctcatggtcagccaggcctggggccctggagaggtcctctgcatcttgaattctgtggagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatacattggtcttg

SEQ ID NO: 4418 - DNA, 2502 bp, Homo sapiens
atgtgtaccatgcataaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcct

SEQ ID NO: 4419 - DNA, 3270 bp, Homo sapiens
attgcatgtaaaatgggacaggaacacgcacctcggttcatgtgcttgaggagtgtttagtgagcacctgctatgcgccaggcctttgggcagtggacacagggatatggccgggatgatagacaggttcagccctgccaacacaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatca

SEQ ID NO: 4420 - DNA, 2627 bp, Homo sapiens
attttggctgcctctgtcggtctgttcagttaccacgtgaaccgccgacggagacccgtagtgggggaggcggcggcagcgttaagtgagaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttac

SEQ ID NO: 4421 - DNA, 582 bp, Homo sapiens
agcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagagaagatgcaagagttagaattataatgcaactttatgtaagaagcagaagttcttccaagaagaggttgagactttaatgtagcatgacacattgaggccacttcggctggtcagcagtgtttgtgaacagtgtgtcaagtcacctgaccaagcagagatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcgg

SEQ ID NO: 4422 - DNA, 1558 bp, Homo sapiens
gcgctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcagcatgtggagagggccaaatgtgaactgtgttgacagcactggctacacacccctgcaccatgctgctttgaatggccataaggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccagacggagatgggcagtgctttgcatgaggctgctttgtttggcaagaccgatgtggtgcaaatcctgctggctgcaggaactgacgtcaacataaaagataaccatggactgactgccctagacactgttcgggaactgccttctcaaaagagccagcaaatagcagcattaattgaagatcacatgactggaaaaagaagtacaaaagaagtagataaaacccccccaccccagccacctctcatctccagtatggactccatatcacagaagtctcagggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctagggaacgtccaccacctccagcaaagccaccgcccgatgaagaggaagaagaccacatagataagaagtattttcccttgacagcttctgaggttctgtccatgagacctaggattcatgggagtgcagcccgggaagaagacgaacacccttatgaactgttgttaacagcagagacaaaaaaaaaaaaaaaaaaaaaaaaaaaa

SEQ ID NO: 4423 - DNA, 3715 bp, Homo sapiens
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 4424 - DNA, 2186 bp, Homo sapiens
gggccggagccggagcccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggagcccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattcttatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatg

SEQ ID NO: 4425 - DNA, 1093 bp, Homo sapiens
aatggagaagcaaatggcaaggatggttaccttggctaccaagataaagaaccttgaaaagggaagaagatgaaatcagcttcggatatcaggcaggcagctgggtctgtgggtcagaggcttaaggatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccctgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcgttccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaaga

SEQ ID NO: 4426 - DNA, 914 bp, Homo sapiens
acgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaataggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaa

SEQ ID NO: 4427 - DNA, 1391 bp, Homo sapiens
atgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccaggtttgtcaccgtttctctccggccggtcagggcaagagccagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaatt

SEQ ID NO: 4428 - DNA, 1988 bp, Homo sapiens
atgggtgcctacctctcccagcccaacacggtgaagtgctccggggacggggtcggcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 4429 - DNA, 2634 bp, Homo sapiens
gactcccgggtccccgcgccggactgggactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagctgtgtga

SEQ ID NO: 4430 - DNA, 3681 bp, Homo sapiens
tctcccggccttgttgactttggcgtccgcggggagctgcccctgtgcccgtggttctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaatgaggttatcttaactctatagaattttaaaagtatatttagaattgttttttctgtagttcactgtataaagtatttggttttttaaaaaaagcaaaaccattgttatgtgtgactcttgataggacacagaacgagtgaatgagcatgagtgaggccactttcttggatggctgtaagtagcagggccagggtagacctggtcagcggatgcactttagcagatggaacttctagtttatctgaatatttatctttgacaaggtagggctgagcctacatttgcttttgatctatctagtataagaaatattcacagaaattgtatgtagataccctttgttttgaaaatgctgttcagaatcatagtgtaatctttgggacctatgccatgttcatttcactccttcccatattttttgtgtttcttttggtaaaactataatggttttcattttttacttaatatcacacagttaaactgtccatatttgagctttattttagcttatcagtgataaaaaacaggtagtaactgccattgtttgtttgttttcctaataaggcctgaaaacagccattccttgttaagaaagtgtacaatgtaacatatttgctagagttacatggattatatatttcttaaagggaaaaatttgagagtatcatggactaccaccagcattattattacagtagttactcagatttggttaaggaagcccaagcaatgtatagtgaaaggattattatctctctgctaagattcagatattgtttcagaaatctcagctccagtaattccacaacatctaaaaacaaatgtttgtgatcatgtgtaagcatgaaattgttccaagtaagtgaggatattttagttatgtgaaagacagtttcatggaaggtatttgttttataccagtggctgggatggtggaattggggttatttctacaattattcttagacgattactaaactgttaagaaatgccccatatcatttttgtatctaggaaagaaaaaaatcagtttcatactgttgtcatctgtcagaaatgctcattttattttgaattaaatgtggcttttgaagtacctagttaccttgaattcctggtgaccacatgtttttatctggaaaacctggagaaagttatctgtcccatctcccctgcttgtttttttttttttttttggttggagctgctgtttagatgatgcttttactatgcaggagagagtttttgttaaggatatatttgaagattggcttttccatattgtccttcattctttgaccatggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacagtaagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaagca

SEQ ID NO: 4431 - DNA, 3770 bp, Homo sapiens
gagagggagccttgctctgttgtccaggctggagtgcagtggcataatctcagctcactgcaacccctatctcccaggttcaagcctcagccttctgcatagctgggactacaggcatgcaccaccacacccagctagtttttgtattttttagtagagacagagtttcactatatgttggccaggctggtctcgaactcctgacctcagctgatccacctgcctcggcctcccagagtgctgggattacagacgtaagccaccatgcccggctggaatcattcatttcttttcaagtgggtatcttatggtattttagggcatggctgggagcagttttgttttctcttctcaagactgagtgtttgcaggatgtcatagagttcatgtctgcagctcacagtgtcattgcctgtgtccccagctccacgtactggcaggtgtgctgcaagctgggtaggtgccctgtgtccctgggataccttaaccgacactcctggccctcctctgcaagctgtgccctgatcctccctgcagggactggggattgggtctgctcacctagaagccaggatacctggctgagggcacttctctccctcttctctttgaacagagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctactcctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtcccacttgcgcagagccatggctcatcacgaggagtcggtgcgggaggccagcctctgcaagaagctgcggagcattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccg

SEQ ID NO: 4432 - DNA, 8887 bp, Homo sapiens
aggtaaatgcgtgcccggaagcgcgacctcgggcggttggaggggctaccgggtcttaccagtccgtggcgggagtcccggaggaccctcgacgggggagttgccgagaaaaggcctcgccggcattcttcccctccactgggtcctttgaacctagtttggctgggactcgccttcaggcggcgcggaggatttcgaggccctgaggcgcggcccttaatttccggaagtgggggccgcgccgcgccgtcaagatgtgctcgacgcccggaatgccggcgccgggggcctcgctggccctgcgggtgtccttcgtggacgtgcatcccgatgtgatcccggtgcagctgtgggggctggtgggcgagcggcggggcgagtacctgcggctgagccgggaaatccaggaagcggcggccacgcgcggccagtgggcgctgggcagcgcctcggcctcgcccggcgagctgtgcctggtgcaggtcgggcttttgtggcaccgctgccgcgtggtcagccggcaggcacaggagagccgtgtcttcctgctggacgagggccgcaccatcacggccggagcaggctcgctggcgcctgggcgcagagagttcttcaatttgccctcggaagtgctgggctgcgtgctagcgggcctggtgccggcaggctgcggcgcgggctcaggcgagccgccgcagcactggcccgccgacgccgtggacttccttagcaaccttcagggcaaggaggtgcacgggtgcgtcctggacgtgctgctgctccatcgcctggtcctcctggaggtgcctgatgtgttccaacagatgcgggagctgggcctggctcggcgggtgcccgacagcctcttccgttcgctgctggagcgctatctcacagcggccactgctagcgtgggctccggggtcccggttctctcgcgagtcccgctcaagcaaaagcagcctggtctggattacttctatccccagctgcagctgggcgtgacggaggccgtggtcataacccaagtgtgccatccccaccgcattcactgccagctccgcagcgtctcgcaggagatccaccgcctctccgagagcatggcccaggtataccggggttccacggggacaggggatgagaactctaccagtgccacctgggaggagagggaggagagcccagataagccgggctctccgtgtgcatcctgtggcctggatggacattggtacagagcactgttgcttgagacttttcggccccagcgctgtgcccaggtgcttcatgtggactatggaaggaaggagttagtgagttgcagcagccttcggtacttgctgcctgaatattttcgaatgccggtggtgacctacccttgtgctttgtatggactctgggacggtgggagaggctggtctcggtcacaggtcggtgacctgaagacactgatactaggcaaggcagtgaatgcaaagattgaattttattgctcctttgagcatgtgtattatgtcagcctgtatggagaagatgggattaatctgaaccgtgtgtttggagtacagtcgtgttgcttggctgaccgagtccttcagagccaggcaacagaggaggaggaaccagaaacatctcagtctcagtctcctgctgaagaagtagatgaagagatttcactcccagccttaagatctatcaggttaaagatgaatgccttctacgatgcgcaggtagagtttgttaaaaatccttctgagttttggattaggttgaggaaacacaatgtcaccttcagtaagctgatgaggagaatgtgtggtttctattcctctgccagtaagctggatggtgtagttttgaaacctgaacctgatgacctttgctgtgtcaagtggaaagaaaatggttattatagggccatagtcaccaaattggatgacaagagtgtggatgtattcttagttgaccgaggcaattcggaaaatgtggactggtatgacgtaaggatgctgcttcctcagtttaggcagctaccaatattggctgtgaagtgcaccctggctgatatttggcctttgggaaaaacttggagccaggaggcagtttccttttttaaaaagactgtgctccacaaagaattagtcatccatattcttgataaacaggatcatcaatatgttattgagattcttgacgaatcaagaacaggggaagaaaacattagtaaggtaattgcccaagctggatatgccaagtatcaggaatttgaaacaaaggaaaatatcctggtaaatgcccactccccagggcatgtttcaaaccactttactacggagagtaacaaaataccttttgccaagactggagaaggagagcagaaagccaagagagagaataaaaccacatctgtttcaaaagctttgagtgacacaacagttgtaacaaatggttcaactgaactagttgtgcaggaaaaagtgaaaagagcatctgtttattttcctcttatgcagaattgcttggaaattaagccaggctcctctagtaaaggagagctggaagttggaagtacagtagaagtcagagtgtcttatgttgaaaaccctggctatttctggtgtcagctgaccaggaacatacaaggacttaaaactctaatgtctgatattcagtactattgcaaaaatacagctgctcctcaccagagaaacacccttgcttgtttggctaagcgaacagtaaacagacagtggtccagagcacttattagtgggatacagtctgtggagcatgtcaatgtaacatttgtagattatggagacagagaaatggtatctgtgaagaatatttattcaattagtgaagaatttctgaaggttaaggcacaggcttttaggtgcagtctttataatttaattcaaccagttggccagaatccctttgtttgggatgtaaaggcaatacaagctttcaatgaatttatagataatgcatggcaaaaaaatctagaattaaaatgtacaatatttgctctggcttcaattaatgaagaactgtttaacattgtggatttgctaaccccctttcagagtgcatgccatttcttggtagaaaagagacttgcaagaccagtaaaacttcagaagcctttggagtcctctgttcagctacattcctacttctattctacacatgatatgaaaattggaagtgaagaattagtttatataacgcatattgatgacccttggacattttattgccagctggcaagaaatgcaaatattttagaacagttgtcatgtagtattacacaattaagtaaagttttgctgaatttaaaaacatctcccttgaaccctggaaccttgtgccttgccaagtatactgatggaaactggtataggggcatagtaatagagaaagagccaaagaaagtcttctttgttgattttgggaatatttatgtagtaacaagtgatgatctgcttccaatacctagtgatgcatatgatgtcttacttttgcccatgcaagctgtcagatgttcattatctgatattcctgatcatataccagaagaagtggtggtgtggtttcaggagactattttagataagtcattgaaggctttagttgtagcaaaagatccagatggaacactgattatagaactatatggtgacaatattcaaattagtgctagtattaataagaagttggggctacttagttacaaagatagaataagaaaaaaagaaagtgaagtcctctgttctacaactgaaactcttgaagaaaaaaatgagaatatgaagttgccatgtacagagtatttaagtaaatcagtagggtacaagttacctaataaagaaattttggaagagtcatataaacctcagatcaactcatcatacaaggaactcaaacttttacaaagtttaacaaaaacaaacttagtcactcaatatcaagactctgtgggaaataaaaatagtcaagtgtttccattaacaacagaaaagaaagaagaaatttctgctgagacacccttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaaggaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttaatatgatggtctcattttattaaaaaggaaatagaactcttaaatatacttggttccatctctcctctgtaatggaggattggggaaagcatagtaatattaaatgttagctcttatgtattagtcacttagcttatactttaaatgcattttttcactttattcatcaactttgaagtgcatatcaatattatccatattttataggtgagaaaattgaagcttcataaagaggttaaataacttgcctaaggtcagatagctgatgagtctcagaggcttgatcaaacccagacctacctaactttgaagcccatgactttttaaacatgattttgcaaagcatagatcttagcttttagaaacagatctgagctatatgctgcttaacagatatgtgacatgggcaaattatgtaatattttgaactttgatcttcatctgtaaagtggtgataataaaacctttcttgcagtgtttttttaagatgagaaataattgatataaagtccctgaaaaggagtaggcatttgataaatgtgtctttctttaccctgaaaaatactcagtgtgcactatgttaggttatttctttttaaccttaacttattagatattttcaatagttattttctcctttcagcatcagcatgcgccaccaacaaaagactgtaaaaaacaaacaaacaaaaaagtgttgaatgggacatccatacagttggaatgcttatttctaaaatgaatagggaaaaggtttgctaaatgagactggggtaaaggtgtatctctgtgaagcattatcagactctgaagcctaatggaaatagaattatgaaccttaaaaacccattataatttccgtaagtagaagggagagaggtttgcattaaaagtaattgaggtagatgagtatattacttattcctggaataatgaatagacaagtttggcttactcatatagataatataatgtgaattgccagaagcaaagctcagagaagatgcattaggatcagattataggaagccttcaatttcaagctgagtttaactccctattttaaaaaatttaatctgaatggctacagaagtaaaatttctcagaatgagtgactttgcacctgacaccactaagataggactagggtaccaaatgagtggtataaatttttatgtcccctgggaaataaaatcattttccatgattcccatatttataagtataaattcttaagctatatttttacctccatttaatcgtgttattctgttttactactacatatagaattgaaaacattaaataaaattaactggaatatgaagaagctaaatgtaattctgaatgttttattatccttcacagcctttgtgtgagtaactaatgtattctaactggaatccctgctatatgctgtaatacctgtggaacctttctttagcaagtagaatgccttaaagaattaaagaaagtgtcaaaaaattaccaatttaatccactgcctttgcctcatctctaatattcttaacccttctctactccttttagtcatcatttgaaattgtgtagtaccaccaatcctgtgctgaaacaatggcttttgcttgttctaatttttcttaccgtgaccaaaagtcaaagagaagagctgccaaattctacctagaatatcatgttgctataattaaactccactgcccatagtagataataaaaggcaagaaattgttttttactctatgtttagggagtcttgtatcattgcaacaggttttcactgggattttgcctgttttaatctacttgtctgtcaaagtaatgtaaaaacagtttttaacttcgacactgaaaaggaatcatctttaaaattaaaatttaggctgatatgaa

SEQ ID NO: 4433 - DNA, 543 bp, Homo sapiens
gagtcggtggtggcccaaagtccaggccgcatccaccgcccggcgcctagcgcaggggcagcagccgggtcgccacaggaggggccccgggtgttcttgccggcttgggggaactttcccagggtcagcccggaggcgccctgcagccccggcatttggctaaacaaagcaagcgctgccggcgcggcccgcccgagggcgccgcgggaagaacctgggcaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggt

SEQ ID NO: 4434 - DNA, 2512 bp, Homo sapiens
aagaaacaagatggcggctgaaggcgatccggagtggggccccaccccccccagcaccagcgccaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaatatggcgagaatctttaggacataccaggttacaccggatgacatcaattg

SEQ ID NO: 4435 - DNA, 1186 bp, Homo sapiens
ctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcagaagaaaagccacgccacttaagtttggcagagatgacgggcagccctttgcatagagcttttccctggacttggagttggtctttccctgaggatctaggactttgggcccctctgggctacctccaaggaatcagtcacctctgttctgctgagtctggagaccaggtggtggggtggacggggcataaggaagagtgatgcatacacagtgctagagtacagaatgcagtaagtgatccatgggggcagagagcaa

SEQ ID NO: 4436 - DNA, 885 bp, Homo sapiens
gagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaagctcaaatagctataactgtaccaaagacatggaagaaaccaaaagatcggacccgaaccactgaagagatgttagaggcagaattggagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccagaatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttag

SEQ ID NO: 4437 - DNA, 1392 bp, Homo sapiens
ttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcatt

SEQ ID NO: 4438 - DNA, 2633 bp, Homo sapiens
aaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaa

SEQ ID NO: 4439 - DNA, 3862 bp, Homo sapiens
agcctggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatc

SEQ ID NO: 4440 - DNA, 526 bp, Homo sapiens
agggcagcctgctcgacaaggccccttggcagacagtcagctccctccaaggccaaaccccaagttcaacatacatctttctctcccatttctgcaagcataactgtgaacagcataattcttttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 4441 - DNA, 847 bp, Homo sapiens
agactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaaggtaagtttagttcactcgtaactcactgaggaaatggattgctctttcttgctgtctaatttcagtgggagaaaggttgactcttgcctatttcttatacccagcaactataattttcctacttaatattctcaagcaaatgccacctccatgtgtgaagtgtgttcctccaggctggttccaaactcctaggctcaagcgatcctcctgcctcagcctaccgaagtgctgggattatagtcatgagccacagtactcagccaagaaaaggatttcttcaggtagggttgtcctttgcacggcaggggggtggggcacaaattgtaatatctaagttttttcacccccttaaaggcaatgtataacctcattaagaatgcatgttttagattaatgaagtttatacttttcagtatccaa

SEQ ID NO: 4442 - DNA, 3497 bp, Homo sapiens
gcggtgtttgtctgccggactgacgggcggccgggcggtgcgcggcggcggtggcggcggggaagatggcggcgtcctccctggaacagaagctgtcccgcctggaagcaaagctgaagcaggagaaccgggaggcccggcggaggatcgacctcaacctggatatcagcccccagcggcccaggcccaccctgcagctcccgctggccaacgatgggggcagccgctcgccatcctcagagagctccccgcagcaccccacgccccccgcccggccccgccacatgctggggctcccgtcaaccctgttcacaccccgcagcatggagagcattgagattgaccagaagctgcaggagatcatgaagcagacgggctacctgaccatcgggggccaggtaccaccttcactgtggcggggagagggaggaggcccagccaggctggacccatcctgggagcgccagtggggggcagggggcggtggcagaccagggaccctccaaccctccctctcctcccagcgctaccaggcagaaatcaacgacctggagaacttgggcgagatgggcagcggcacctgcggccaggtgtggaagatgcgcttccggaagaccggccacgtcattgccgttaagcaaatgcggcgctccgggaacaaggaggagaacaagcgcatcctcatggacctggatgtggtgctgaagagccacgactgcccctacatcgtgcagtgctttgggacgttcatcaccaacacggacgtcttcatcgccatggagctcatgggcacctgcgctgagaagctcaagaagcggatgcagggccccatccccgagcgcattctgggcaagatgacagtggcgattgtgaaggcgctgtactacctgaaggagaagcacggtgtcatccaccgcgacgtcaagccctccaacatcctgctggacgagcggggccagatcaagctctgcgacttcggcatcagcggccgcctggtggactccaaagccaagacgcggagcgccggctgtgccgcctacatggcacccgagcgcattgaccccccagaccccaccaagccggactatgacatccgggccgacgtatggagcctgggcatctcgttggtggagctggcaacaggacagtttccctacaagaactgcaagacggactttgaggtcctcaccaaagtcctacaggaagagcccccgcttctgcccggacacatgggcttctcgggggacttccagtccttcgtcaaagactgccttactaaagatcacaggaagagaccaaagtataataagctacttgaacacagcttcatcaagcgctacgagacgctggaggtggacgtggcgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacaaaacaaaaaacaagaaaaaaaaaacacaaaaccccgtaaaatcacaaagaaaatccaacaccaaaggcgcagaagccggctggccgtggtgggggcagcgtaggcgtagcatccctctcctctcacttagcctgttgactcttgttattatcatgatattcacaaaacgccgcatgtttaaaaagtcatagatgtcatcttctctctgcccccagggaggaaagccaccttctcttgccccttggcccctttgtcaggggccaggggtctgccgggtgggggtgccaacaggcctggccctttcctcccctgcatccagccatgggggcctctgcgattgccggaaggttgcatggctggtcccagggccagcacaggcccgaggccgggctgcctggttttatttttatttaactttattttctgttttatgagtgtgtgtccgcccacccccacccccttcagtgttaagtggggagccctgggggagtctctcctgcctcccagcctctcccaagacctcccccctcgtcaccagccatccctctggaccaggcagagggcggaccgggtgggcaggggcctgagggtggctcgggccagcccaccagccaatggacccctcctcaggccgccagtgtcgccctgcccctttttaaaacaaaatgccctcgtttgtaaacccttagacgcttgagaataaaccccttccttttcttcc

SEQ ID NO: 4443 - DNA, 2122 bp, Homo sapiens
aacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagagaggaagagcaagaggtagcaagtgcttccttctgactagtaatgctggtgtaattg

SEQ ID NO: 4444 - DNA, 4422 bp, Homo sapiens
cgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggctggagtgcagtggcgtgatctgggctcacctccctggttcaagcgattgtcccgcctcagcctcccaaggctgggattacaggtatgcaccaccacgcccggctaattttgtatttttcatagagactgggtttcaccatgtagaccaggctggtctcgaattcctgacctcaagtgatccacctacctcggcctcccaaagtgtggggattacgggtgtgagccaccacgcccggctaattttttgtatttttagtagacagggtttcaccatgtgggccaggctggtcttgaactcccaacctcaagtgatccacccaccttgttctcccaaagtgctgagattacaggtgtgagccaccatgcccagcctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgctggtttgcactgggcacggggactggagagccaccaggccactgagcgcagcatgctatcacttctcaggaagttgtgagggtgaggagaatagccgggcccactctgcagaggggaggaacaggcacaggctagaggcacgggctgatagagtgagtcctctccctcattcattcattcattcattcattcatccatcagacacctgctgggcatctgctgtgtgcgagacactgtgctgggtgccccagacacaagacagaaactcgggtcgctctgtgtgcctccacactggccttccctgctgcgtggacgcaggctctgtctcctaggctttaagccccatgcatcaggtggaagacaatttccagcagcctctgcccgcttgtttttcctcctctccttttcctgccgccttggtcttttttgtcttttgtgcagggccgtctctcgcagcgcccgtctgtgctccgcagcgtctaggaaaggattagtgtgagcagagcacgcaggctttggtgaacagagccgagcttggtttcaacatctaattcaatttgttctgccgagattgaaatatgaaatggttgccagtcaaacgttcaaaggacggggaagggagagtgagcgcatgctgaaatttaaattttaatgaaaatgactttaaccctttggtacaccttgcaaaatgtaacccatcctcccatcctgtgaaagcggcctctcgggttagagcttttccacccacttctcttccactgagcttcactaataatatgtaatcatttttttcagccgtcttaataataaaagattaatag

SEQ ID NO: 4445 - DNA, 987 bp, Homo sapiens
caacggaccctacctcttgtagtgattctcggggccacgggcaccggcaaatccacgctggcgttgcagctaggccagcggctcggcggtgagatcgtcagcgctgactccatgcaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtg

SEQ ID NO: 4446 - DNA, 4233 bp, Homo sapiens
ttgtatagtaagtttattgtatagtaacttgtaagtatattcgtaaaaggtaaaaccaaaattttactcctatggtaaaatttttatatacctagacattgtagtcactggaaaatgtgttattttccctccaacttagaaaggcaaaatagctgtcataatcaaaaatacaggtgcttcttcaactatggggagagggatcatcttggaataaggagagttttaggatcctgccttattaagagcctggacatatttatagaggaagtgttccaggtaggaaatgtggttttaaaatatgtgcacattcaaaataatgacttacaatatacttgctttgctaggaaactgaataaaattacaaaatttattgaggagaataaagaaaaatttacacagctagatttggaagatgttcaagttagagaaaagttaaaacatgccacgagtaaagccaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaag

SEQ ID NO: 4447 - DNA, 2542 bp, Homo sapiens
atgtttcttaccagaccgaaggtctgtgttgaccttaaccggagagtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattatacc

SEQ ID NO: 4448 - DNA, 1217 bp, Homo sapiens
gatgcgctcgagtgtgggcggggactgagggaagaagtgaaaatcggactgccaggcgacagttcctccgtttgaaatctcgccggctcctgagcgggccaccgggcccgggctgggggtctggcgggagaaataactttatttggactgagagctggagaatgagaataggacctgagagtatattgggctaaggaggagagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggaaacgcagcctgaggagggacttctgcctccttcatcctttctctgcagcttgtctcctccgtcagcacctgggcttgctgatctggacctagatcaagagatgcaggctataagtgagggatcctataacaaaggaaagagcccaggcatgctgggtgacactccctggcgtttcatgggtgcccttcccagaaagctgcagccactctccaaaggccaaccttcccaaatccaccaggtctttgctgacatggagaaaatcttaggcagggccccagcccaatgcaggagagaattaggtgatcagcagggtctggagaaactccagaaggcgacagagaaaatctacctggggttttcagatcctgaaacagaagagctggaaatgagaagcaggcagcagaaactgggcactccagcccctcagaacactgggcttctccaaaatatgcaggatgtggtagaaagcaggaaccaggcctctgtccactcaaagctttctgaagccatcaaaggcctgccactgaaaggggagcagcacagccacagcttagccaaactgagccccactggccctggaggggacaagggccaaagccccattcccatgtggatctgctgcaggctcagagccagcaactgcagaaacacttcagcagcctggaggctgaagctcaaaagaagcagcacctgttgagaga

SEQ ID NO: 4449 - DNA, 506 bp, Homo sapiens
acagcgcgcgtccaagtggagaacaaagtgacccccagaacttctccaactcctcccggcgttcccgcgagggccacgcgccgagggtagcggagggcggcgcgcgaccggccccaccgagcccggcgcgcgacccgagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagca

SEQ ID NO: 4450 - DNA, 1542 bp, Homo sapiens
ggtgcgagtggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggtggcccaggatggggggccgcaccttgacccacagcacacggggaggaggggtcaccttgaagttcagagcgcgggggctgcggaaaacaaaccagcccttcctgctctgccccccagcctggcccagtcagaccacagctgtggggtgatccaggcctcctcaggctttgtgcacctcaggttctga

SEQ ID NO: 4451 - DNA, 367 bp, Homo sapiens
caaccctgcgctgaatgctgcgaggaacaaaggagatggacaacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccacct

SEQ ID NO: 4452 - DNA, 2178 bp, Homo sapiens
cgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagaggtcttttcacagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttgg

SEQ ID NO: 4453 - DNA, 1802 bp, Homo sapiens
caagaagaaagaggaggccggcttttcagctagcatcatggcgtggccgtgcatcacgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctccca

SEQ ID NO: 4454 - DNA, 2818 bp, Homo sapiens
atggccctgggtgaagaaaaggcagaagcggaagcatctgaagacacaaaggcccagtcctatgggagagggagctgcagggagcagcccccacgcctggaagctgagggagggctcatctcccctgtatggggggcagaagggatacctgcccctacttgctggattgggactgaccctggcggcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaatgtctggtatgttatagctcagttgactattatacctgaaatctaattagagcttcacattcttaaagcggaacgctttgtaaaatgcatgaattatttcccaggccaaatggagcttgaagatacaatatatttatctcaaatcaaaaatactttaggttttgggctggcaggtgcagtgggacaagtcttttatcccagctactctggaagctgagacaggaagattgcttgagcccaggagttcgagtacagcctgagcaacatagcaagacccccccccctcaaaaaaaagttttttcttaattaaaaacaaaaatactttagggtgatttgcaatataattttccaaatgtctcagggattataaatacagacttgcactattatgacgcctctagttatgtatggctattgaagtaaaattaaagactcagatttttttatttgcactagccacattctgcatgttcaaccatcacatttgtctagtggctaccacgtagaacagtgcagatgtagaacacttccatcaccacataaagtcctattggactgcaccactatttaaagatctgagctgaaattgtactgactccagaatctacaatagggcattttgatggtatttaaatagaaatctaggccaggcaccttggctcacactattaatcccagcactttgggatgctgaggctggaggatcgcttgagcccgggagttccagaccagcctgggcaatatagtgagacctcgtctct

SEQ ID NO: 4455 - DNA, 1942 bp, Homo sapiens
agcgtccaggacagcccaggctcagtcatgaaaagctatgtgtcagagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagccca

SEQ ID NO: 4456 - DNA, 1975 bp, Homo sapiens
ctcgcgggtccgggagcgcggcggagacgatgcctgagatcagagtcacgcccttgggtgcctgccctgtgctgtcctggaacctggtccttccaccgggcagggggtcgagggcaccttccagcacagacaccaggacgggattccatgtcctcccccatggcgggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctct

SEQ ID NO: 4457 - DNA, 2579 bp, Homo sapiens
atggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagagcttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccacccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaa

SEQ ID NO: 4458 - DNA, 2449 bp, Homo sapiens
tgagggcggaagggacaggcataggagggactctgtgggaggcatttggggttggctttcctaggcccctggcccacctccaccttggctttggagaaggggagccgctacaggggatggcagctgggaaaggccccctggccacccccagcaaccccactgctggcttctgtgtcagggcccgccgaaacccaggcccactcttcctagaggcctgtcagcagccactagggccagggactgtgggtgaggccactcggaccctgcccccagtctgtctgggcctgagaagggcctggtgtgcggtgggcttgcagcactcagtgatggtcaggccaggcaggttatgtgttgccctctcccaccctagcgtccccaccctccccaggcagactcttcccagcagcaagcggaagcccgggcagaggctgctgtcataggcagaggcccccgctgatgccggccctgcttgcccctcacactgccaggtcttcacgtgctctgtgtgccaggagacattccgccgaaggatggagctgcgggtgcacatggtgtctcacacaggggagatgccctacaaggtcaggcttggcctgtctccagggccagggttgggtggccccaggatccttcctgctgagccctttacgtggggtgctgtcaggcacctccctcacagtagctgtcagggagcctgccttccctgccttccctgcctttccagtgcccccttatctaggcagggcctgtctgcagcctcacctccaaggtccttattaggcccttgtttctttccatggaggacaggcttggcatcctctgggcagctgagccctgaggccctcctttgcaccatccttcacaccagatcaggggtcctcccagaatcatctcaccggggcctccctctagttcctgccctatagcccaagggtgggtggcagggtttcatgggtgcaggccgccctggaggtgactgtgggcctctttttcagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaaggtgaggtacgccctgcccctcccctcgcctccccatcctgaggccaaggccacaggctgagctcttgccttgtgcctgcagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaaggtacctgggcggccctgggagagccatttcctgctcatccgagttggagggtctctgaggaggaaacgctcctttcttgcctgtgaacctcttttgtgccccacatggttagagttgagagtggacctgctttgaaggcaggggtgtcctgtgcagtagtgaccctgggtggcactggagagcctggcagggcctgtgcagcacttgtaaaccactggtcccctcccttgctgcctgtcccaacctcctgctgggtttcctcgagggtcccggggctcctgcatgatcccccacggtgttctccctcttgcagccgtggagcaactgcgtgtgcacgtcagacggcacaagggggtgaggaagtttgagtgcaccgagtgtggctacaagtttacccgacaggtaggccagggcctgggccccttcccctaccctaggatcccccaaagttctgagctcaccctccccgccaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttgg

SEQ ID NO: 4459 - DNA, 1422 bp, Homo sapiens
actgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactagagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgt

SEQ ID NO: 4460 - DNA, 1653 bp, Homo sapiens
aagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgca

SEQ ID NO: 4461 - DNA, 1632 bp, Homo sapiens
acagaatgctgggctgagagcaggactgagatcctagaggcagaatcccagtctacccgtactctctgggaggaagtgatgagaacttgcagcagggtggtggtagtgaaagagaagaatgaaagacaaggaagcatcagtggaacttgatgtgtggctggataccagaaatgcagaggaagttagtcaaaggttcccgtcctgatgactggagatcatggtatcactgactgagctctaggggttgtgaaatagagctcattaggcagaggatgagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttag

SEQ ID NO: 4462 - DNA, 570 bp, Homo sapiens
ctgcttccgggtcacgccttgacagcggctttcaacccccacctcagcccagcaattcgtaccggacctaccgggattgctgcgatctgtttagagcccgtgcagaaagtgacaccgcacgtccttgcgtttcgtgcccttgccccccgccccctagcctcagcgagacagctgccgcgggccctcccgcagcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttg

SEQ ID NO: 4463 - DNA, 2224 bp, Homo sapiens
attctccgggctgcggagggtaaagagcgggctcgggccgaggctggagggctgggtggggccagagcggcgcttcgggggcccgcggaggacgagggagggagagaatctgaggagctgggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccag

SEQ ID NO: 4464 - DNA, 3068 bp, Homo sapiens
ggggattggggtcgggtcctccccagtgagaggcgacaggagctcactgcctctcgggccctcacaatcacacctgtcacaggtatacacgctgccactcacaaacacacgcttgcactcccagcctcactgacacgctgccatacagccgctcacagccagccagacactgctgcacctgagagcaggtggccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagagaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtattttaaaaatatggcatctgagcaggagcaacaaacctgggatgggggtggctgaggagggccactgtcatcctccctcccgggctctggtcacctttgagaagcccaagcaggccctcagtataagctgaagctgacctctgccttcctcgaagcctcctgggatttctaaaacttatacttcaaacacagcacagacagaaagtaccactcagctattagaagaaacatctatttgggaaggaaaaatatccctgctcatgagagacagagaccattgtcttcagatgtgctagcatgaaaacagattttctcttcttgtctaaattttctctgagtcagacaaattttccttctaggagaaaatttttttctaggagggggtggagaactttttttttttttttttttttttgacacggagtcttgctctgtcgcccaggctggagtgcagtgatgcgatcttggttcactgcagcctct

SEQ ID NO: 4465 - DNA, 2881 bp, Homo sapiens
gcggcggtgcctgggcggcagcagcagcagtagcggcagccctgaggacgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccg

SEQ ID NO: 4466 - DNA, 768 bp, Homo sapiens
atggccgcgtccaccatgtccgtctgctccagcgcttgctccgactcctggcaggtggatgcctgcccagagagctgctgtgagccccactgctgcgccctcagctgctgcgccccggccccctgcctgaccctggtctgcaccccagtgagccgtgtgtccagcccctgctgccaggcagcctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagcctgtgtgctgcctgcccacctgctctaaggattcctcttcatgctgccagcagtctagctgccagccaacttgctgtgcctcttcctccagccagcagtcctgctgtgtgcctgtttgctgcaagcctgtgtgctatgtgcccacctgctctgaggattcctcttcatgctgccagcagtctagctgccatccagcttgctgcacctcctccccctgccagcaggcctgctgcgtgcccgtccgttgcaagcctgtctgctgcaagcccatctgctgtgtgcccgtctgctctggggcttccacttcatgctgccagcagtctagctgccagccggcttgctgcaccacctcctgctgcagaccctcctcctccgtgtccctcctctgccgccctgtatgccggcccgcctgctgtagcctctgctcaggccaggagtccagctgctga

SEQ ID NO: 4467 - DNA, 3257 bp, Homo sapiens
gtctgcgcaagcgctaaccaagaaacgacggtttcgggtagattgttggttaagaagaaagctgggaaagtgaaggagagggggaagaaaggaagtgaaaagactttggctgttggaatctcagatctggaataggctgtataggctatttataatctctaattgccgaggaacctgaagttcagagttaaccagtgactgactcaggacatgcaaaatggcaagacccgaggtagaagagctcacctttcctgactctcagtttcctgttccctgaaaattcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgggagttcagtagatgaagtttccttctatgctaaccgcctcacgaatctagtcatagccatggcccgcaaagagatcaatgagaagatcgatggctctgaaaacaaatgtgtctatcagtcattgtacatggggaatgaacccacacccaccaaaagcctcagtaagatagcatcagagcttgtgaatgagaccgtctctgcatgttccaggaatgctgccccagacaaggctcctggctctggagacagagtctcgggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaatggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccttgtggcataaaactcagcagaaagaatgtaaatctctaggtttccagcatgcagcatttgaagctcccaacacacagcgtaagcctgcatcagacatttcctttgagtaccctgaagatattggcaacctcagccttcctccatatcctccagagaaacctgagaattttatgtatgattcagactcctgggccgaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcag

SEQ ID NO: 4468 - DNA, 1906 bp, Homo sapiens
ctacgagcggcatcctgcctgcgttagcggcggtggaggaggaggcagagaggagtggagggcggagtagacggaggaggctgctgcagagaagaaagtgtcagagccggttcggctttagagtgtggtgaagggtacttttcatggtgcatggaaggaaagccaatgcgcaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatctt

SEQ ID NO: 4469 - DNA, 956 bp, Homo sapiens
ggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgtacactaaataaacagtcaacttttggggtgtggatggaaggggggtccattttaaaagtgcttttacattgaatttccctcccagattagatcagcaaataaatgaaatttattaaaagaatgttgtgtctttaatagccatgctgttcagtgtagaaactttaaatctctcattaattttctgtgtattgtatcatgtacagcctgttagatatt

SEQ ID NO: 4470 - DNA, 2671 bp, Homo sapiens
atgttatttatttttcctctttccctcccgtggagaccctcctgttggaaagagagctgcagcacgggacagagacaggcaggaagaagcagagaggactcggtgacgcccccaccgagcagcccctggcccactcctccagcaggggccatgagcaccaagcaggaggccaggagagatgagggagaagccaggacgagggggcaggaggcacagcttcgagaccgagcccacctgagcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgtctcagccgcctggggttagagaaaagggtcctaaaagcctcagctggggacctggcccctgggcccccaacccaggtggagcagttggagctacagctggggcaggagactgtggtgtgctcggcacaggtggtggatgctgagagtcctgaattctgcctgggcctgcagactctgctttctctcaagtgctgcatcgacctggagcacggagtgctgcggctgaaagccccgttctcagagctacccttcctgcctttgtaccaagagcctggccagtgactgctgtctcagtcagtccccagagggaaagaccttgccttagaagaagaggcgtgtggggaacgggggctcttgaagccaggtagctggggactatggtgtctgcccttccaatcacctccctgacccctgctgtcccattttccccagctggccgcattcctctctgcttctcagcagctgtcctactccccaggacgagttttcactagagggcccacgatgccaggattctgattcatcttcctcccaagaaaagcaaagccaaatcaagaccacagataggaacctaagcacaatggggtgcctgcttgggctgggtcgaaggctctgctgactgctgtccttgtccatcacccaataccaccccaaacacaactcaacttcccacaccaccatgtctctcaccacaccttctgggcctcattatctcccacaactagaccgccatgcctcaccaacctatgtccctggacctcctggtgtctgcctctcggagtctgtgcacatctgctcacagttgagtgggggaagaaacagccagaattcaatacaacaaagagcgggagttagtataggaatgtccatctcataaggctgagagctattttttcctgtggctgcaaatgtctgaagccagttagtttgattaccctgtgcaaaaccttggacatacttctgctattaacgctataggtatttatccgtttccactggctttttgtacccaccgagcccctgagccttgcgtgtgtgtgtgtggaagagccttgtagagaactgctcctgtgaggcagacaggacagtgaggttgtcaccactcagacttcacctattcagcattctttctgatttctagaactatccacctcattaggccttcttcctatccccatctctggcctcttgagcttaagcttgtattgtcctggaatcagtggctttctaaccccctgccaggctttgccaaagcaaaaagacagaggctttttttttttttttaaagtttggggtctgtcaggagacagaggcttttttgaattcactgtgaagagaagaacccgaaccttaagacgccagatccctgagagtctttctggctggtttgagtctctcaaatcatggattaggagtaaagaaagaggccaggcgcaatggctcatgcctgtaatcccagcactttgggaggctgaggtgggtggatcacttgaggtcaggagtttgagaccagcctgggtaatatggcaaaaccccatctctactaaaaaatacaaaaattagccaggtatggtggtgaacacctgtaatcccagctacttggaaggctgaggcataggagttgcttgaacctgggagatgggggttgtagtgagccaagttcgtgccatcggactccagcctgggtgaaggagtgagaccctgtctccaaaaacaaacaaaaaaggagcagagaaagacagtggtacagctaacctgaacaagggaactgggaccgttgggctgaaacagtcttgagcctggggttgactgggttagagaagaaccgggatgcaaggagctgcctgtgacacctggcctgccctttctcagctgcctcccctgccctttctcagctgcctcccctgccctcagaaggaaaggagagggctcacttatcacttgtgccatagcacctggtctcaaaatcctaaaagctttcctcgccctcactgccttgctccacaaggtccactttcctgggtcttgtgctgtgcctttccttgtctgcctcctgctgcttctgtaactgcagaccccaggcccaatggcaagccctcggctcagctgcttctccattggaataaactcttgtttctct

SEQ ID NO: 4471 - DNA, 243 bp, Homo sapiens
acctcctgctgcagaccctcctcctctgtgtccctcctctgccaccccgtgtgcagctgctccccagcctgccagccaacctgctgcatacacagcccctgccaggcatcctgctatgtgcccgtgagctgccagcccatcatatatgtgactccctcttgccaatcttcggggtgctgccagcccccctgcaccactgccctctgcagacccatctcctgcagcaccccttcctgctgctga

SEQ ID NO: 4472 - DNA, 2308 bp, Homo sapiens
gttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcggcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggttttagaggatgtccttgggaggatcgcaaagcagtctggtgagctggagagccacgcagatcgcctgtatgactctatcttggcctctctggacatgctggctggctgcacccttatccctgacaaaaagcccatggcggc

SEQ ID NO: 4473 - DNA, 960 bp, Homo sapiens
gtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagagttatggtgaagctgaaacagtgctcaagatgaagcagctaattgaagacactgaaaagaataaagtttatgttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcct

SEQ ID NO: 4474 - DNA, 853 bp, Homo sapiens
agccccttgtggctgagggcagagctctttgcgttggtccacggtgtgctcctctgcccgggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggggccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggtgcccaggtggccttagccgcatctgtgccagactggtggcctacagtctccaagtagtccgaagccttggctggcgcaggctgatggggaggctggggcctggggcctttggcctctgt

SEQ ID NO: 4475 - DNA, 1110 bp, Homo sapiens
gcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacattggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcttccttgggttgccagctgagtcccggtattagggaatagtttcagctctttcaaagtgcacagtgttacagtcgaatgggctcccatcctg

SEQ ID NO: 4476 - DNA, 3476 bp, Homo sapiens
aaaaatgttattcttagtagaaatggggaaatatcaaagaggagtaagtttaagagttctgtgatgcccttaaaagtcgacggggaagtccagcagctggagatgagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctatgtaaatgagaacatactcactagtaactgtacatttcaacttatgtttgacttatgtgatccattgaaaacatagaaatattatacaaagctttataaaccacagactaccttatactttgaaagaaagaactttcataagtgttgagttttgaaaaattatcaaattataccttcaccttttttcttaaaaggtttgaaatagctagaaataaaggtatctattatattgttaataaaatagaaaacaatttc

SEQ ID NO: 4477 - DNA, 3923 bp, Homo sapiens
agcagtagcggcagccctgaggacgatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacagg

SEQ ID NO: 4478 - DNA, 1662 bp, Homo sapiens
gacgtacctcacggaagccggctttggccctgcggctgctaccgtcgccgcggagaaattgttggatctggcagtctaggaatggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttcc

SEQ ID NO: 4479 - DNA, 4173 bp, Homo sapiens
ggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccaccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagaccttt

SEQ ID NO: 4480 - DNA, 4121 bp, Homo sapiens
aaagctaggacaaactcccgccaacacgcaggcgccgtaggttcactgcctactcctgcccgccatttcacgtgttctcagaggcaggtggaacttcttaatgcgcctgcgcaaaactcgccattttactacacgtgcggtcaacaagagttcattgcaaaaaaattgttacctcctggctgcttgtctaatacatagtgttaatcatgctttgccaagcgacttgactgtaatatttgcgcgtggaagattaaaaagatgttaaacacccaaggtagattcaaatgtgaatgattggtcggttggccaatcagactggttaacaataacattactcgggaaccaatggactccaaggggtggagacggcgtagaacgaccgaaggaatgacgttacacagcaatgtggcaccacaggccaatagcagggggaagcgatttcaagtatccaatcagagctgttccagggcggagtctaccaatgccgaaagcgaggaggcggggtaaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 4481 - DNA, 2423 bp, Homo sapiens
aattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacag

SEQ ID NO: 4482 - DNA, 4568 bp, Homo sapiens
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggtaagatctgaaatctaaagatgagtaatttggggttttgtaatgccaactgcaagtaattacaatattttaaaaatccatttattttacataagattttttgctttgcttttggatgggggaggtgttgttgctgttatttttaatgtgaacagtgttcttgctttgtacctggagagctctttctcaaatgtgttaggaattttccatattattaaaatgcaatttttgtgtgtg

SEQ ID NO: 4483 - DNA, 1522 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaatctgcctaatcacctggttatccccacagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctga

SEQ ID NO: 4484 - DNA, 574 bp, Homo sapiens
gaagtgaagggtggcccaggtggggccaggctgactgaagtgagtagtgggggtgccagaccaggtgcgtctgccgctggattgtgataggaagcagagtgttcgtgtgatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagat

SEQ ID NO: 4485 - DNA, 581 bp, Homo sapiens
ggagctgtgggcgcggcgctgctctgccgttgggtgaggcgcggagcgaagtgaagggtggcccaggtggggccaggctgactgaagagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctggg

SEQ ID NO: 4486 - DNA, 3609 bp, Homo sapiens
ggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 4487 - DNA, 1182 bp, Homo sapiens
atcagagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcatta

SEQ ID NO: 4488 - DNA, 1825 bp, Homo sapiens
tgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaa

SEQ ID NO: 4489 - DNA, 1029 bp, Homo sapiens
gttccagggtcgggtttggtggattcctcagtccctgccgccgcggggcgccctgggatagcggcggggcctcctgaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctg

SEQ ID NO: 4490 - DNA, 1539 bp, Homo sapiens
cgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaa

SEQ ID NO: 4491 - DNA, 623 bp, Homo sapiens
gcactaagcacatctacaatcaaggagaggggcaggctttaccttttgaaggaagaagtatgaaagtgtatcactgactgatcaagtagagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacag

SEQ ID NO: 4492 - DNA, 5298 bp, Homo sapiens
aacgtgatggcgtcaggggccggggcgccgcttcctgttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaggtattgttggaattcagcaaagcccaggtaaactctgtgccaaccaacggactgagccaagaaacggagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcactcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttcggcctgtgaggattctccccgaaggtgccctcggaggcagcaggtttgaggccctggggggcccgttccccagaagctgccagtgctttcagatgcattgactcttcccacctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctcatc

SEQ ID NO: 4493 - DNA, 581 bp, Homo sapiens; identical to SEQ ID NO: 1925

SEQ ID NO: 4494 - DNA, 348 bp, Homo sapiens
atgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagtgagcgtcttcgatgcctatgtgcttcccaaactgtatgtgaagctacattactgtgtgagttgtgcaattcacagcaaagtagtcaggaatcgatctcgtgaagcccgcaaggaccgaacacccccaccccgatttagacctgcgggtgctgccccaggtcccccaccaaagcccatgtaa

SEQ ID NO: 4495 - DNA, 2190 bp, Homo sapiens
gttttcaaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaatagggagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtga

SEQ ID NO: 4496 - DNA, 581 bp, Homo sapiens; identical to SEQ ID NO: 1925

SEQ ID NO: 4497 - DNA, 5891 bp, Homo sapiens
gcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggt

SEQ ID NO: 4498 - DNA, 581 bp, Homo sapiens; identical to SEQ ID NO: 1925

SEQ ID NO: 4499 - DNA, 744 bp, Homo sapiens
cgcagctcggagcgccggggaagagagagtccgaaccgcggctctgccccgcggcctagcgttgctgcctgctttctccagccccttctcggcgtctggaagtgcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagcccc

SEQ ID NO: 4500 - DNA, 582 bp, Homo sapiens
tatattgcaaggcccagtgttataaataacttaatggtggtgctgatcataaaaaccacaaaaattcaaagaaggaaaataatgttttttgacctcttcagccttttaaaaatcctattccttgcctagtcgtttgtaaaccacacagagctccacgggggtcttagtacctcttggggaaatctcgtgctagactaggttagagtagaacatttgtgtccaggtttatccaactccctaggcaactattataatccaattccttatgattatggaaatagtattaatcactccttgaaatctgcttttagcattgggaaggcctcagagaagacctaaccctaaagacaggtgtgctcagtgatattgtatatgccgaaaacttctttgtttcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcat

SEQ ID NO: 4501 - DNA, 3888 bp, Homo sapiens
ggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatcc

SEQ ID NO: 4502 - DNA, 2053 bp, Homo sapiens
gcggtgaccacgtgacctccgctgagctttcgccagtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcagctttataggtgtgacctacacatgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatcaaagcca

SEQ ID NO: 4503 - DNA, 876 bp, Homo sapiens
cttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttggaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaa

SEQ ID NO: 4504 - DNA, 2841 bp, Homo sapiens
gagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttagggctgcccaaacactgtggaaaggggacttggggagcattttcaattccacattcctgattaaaaggtctagtttttt

SEQ ID NO: 4505 - DNA, 4076 bp, Homo sapiens
taaagagatagagtctcactatgttgcccagacaggatttgaattcctgggctcaaggtatgcttctgtcttagctcctcagtagctgagaccatgggcacccaccactgtgcccagattcgggctttcttgtaaaaagcggatggatgcttgaaactattttctgaatccctttggctcccaaatgtgaatattctgggaaatatttttatccaaattagctgagtaatcgagtagttaggcacattttgaagactgaggcttgtcctttaaaagaagggcagcccacaaactgacttccttgagccaaaaattgttttaaaaggggaagtacagcccaaaacagtgattttaaaatatcaacaaaaagagtcaaattctgtaaaatatttaaagagatttattctgagccaaatatgagtgaccatgtcctgtgacacagccctcgggaaatcctgagaacatgtgcccaaggtggtcagggtacagcttggttttctacattttagggagacatgaggcttcaatcaaatacatttaagaaatacattggttcagtccagaaaggcaggacaacccgacgcgaggcagggagcttccaggttatagaggtcactggagagcccggtggggtgtaagtacactgcgcttataaaactctagcaggaagctagcagctgtctccaaacccagagaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaata

SEQ ID NO: 4506 - DNA, 894 bp, Homo sapiens
acgcatgcgcaaaggcatggagaccgtggggtgagaatgggcttgcgagtttacccccacctccccagccaccagcctgtgggtctcaaaccaaggctacttggtgctctgctttgagttgcagaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaa

SEQ ID NO: 4507 - DNA, 3118 bp, Homo sapiens
acacaattcaggcagtggagagaaggccgtggggagtggctgaggagtccctcaagagaagaggttgctgttcactgatggtggagtgttttgagagtggtggaaccaggttatccctttcttcttttaacgtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaggtattgttggaattcagcaaagcccaggtaaactctgtgccaaccaacggactgagccaagaaacggagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattctccccgaaggtgccctcggaggcagcaggtttgaggccctggggggcccgttccccagaagctgccagtgctttcagatgcattgactcttcccacctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 4508 - DNA, 586 bp, Homo sapiens
agtgaagggtggcccaggtggggccaggctgactgaagtgagtagtgggggtgccagaccagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagacttt

SEQ ID NO: 4509 - DNA, 4995 bp, Homo sapiens
agaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgagatgctgaggagggcgagttcctccttagcttcctgcagggcctcacgtccttgtccttcgaactctcctacaagtctgccatcttaaatgagtggacgctcaccccactggccctgtctgggctttgcccgctttctgagctggaccctctctctacctctggtgcagaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagaggtattgttggaattcagcaaagcccaggtaaactctgtgccaaccaacggactgagccaagaaacggagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcactaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcactcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttcggcctgtgaggattctccccgaaggtgccctcggaggcagcaggtttgaggccctggggggcccgttccccagaagctgccagtgctttcagatgcattgactcttcccacctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 4510 - DNA, 1522 bp, Homo sapiens; identical to SEQ ID NO: 4483

SEQ ID NO: 4511 - DNA, 571 bp, Homo sapiens
cagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 4512 - DNA, 2038 bp, Homo sapiens
aaaaaaaaaaaagtaccaaagccgaggcgcatcctcgcacctgcctgccttgggccagcgggcggggcccgggaacgtgcatttcaaaggggccgcggttcctgcgatgcgctggactctgggaagcgcgaacagagcgttttgcgggctctgcggggagagctggcgccggcgtctccctgtagcaggactgggcgccgcgcccgtgggtgggctgctgcccggccccgccgcccagccaagccgccgcctgggtggccattcccaagccggactccggggaagtggcagcgtggatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagc

SEQ ID NO: 4513 - DNA, 2391 bp, Homo sapiens
gcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaa

SEQ ID NO: 4514 - DNA, 2072 bp, Homo sapiens
acctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaa

SEQ ID NO: 4515 - DNA, 581 bp, Homo sapiens
gcatttgtgtcttttggacttctctgagcgggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcag

SEQ ID NO: 4516 - DNA, 1025 bp, Homo sapiens
aacgtgatggcgtcaggggccggggcgccgcttcctgttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcaactacagcggaaggaatctctggattccatttcgcattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgtgaggagcccatgtcctgtgactcagacctgggcacagcaaatgctgaggactcagaccggtctctgcaagatataaagattttcagctgggcgcagtggctcacgcctgtaatcccagcactttgggaggccgaggcgggcggatcacaaaggcaacagatcgagacctttctggctaacacggtgaaaccccatctctactaa

SEQ ID NO: 4517 - DNA, 3609 bp, Homo sapiens
ggcggggcctcctggtgagcgcgcgccggggcggcctccgggaagtgggagacgctgcgggtcctgggcccaggccttgggatgggcgggaaggcctggccgcgccgggctgtgggcactgcaggaggcccctgtgcagaacagatctcggcccctttccaaacactcctgatgcctcatttgcctctcgcttcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggctactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 4518 - DNA, 3757 bp, Homo sapiens
aggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaa

SEQ ID NO: 4519 - DNA, 646 bp, Homo sapiens
ccgtggggtgagaatgggcttgcgagtttacccccacctccccagccaccagcctgtgggtctcaaaccaaggctacttggtgctctgctttgagttgcagagaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggaccctttacaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacc

SEQ ID NO: 4520 - DNA, 2041 bp, Homo sapiens
gcggtgaccacgtgacctccgctgagctttcgccagtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcaggtgtgacctacacatgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatcaaa

SEQ ID NO: 4521 - DNA, 580 bp, Homo sapiens
gagtcggccaggaggggcggccgcggcaggtgcaggtgctggcgccgtgcagggcgcggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgc

SEQ ID NO: 4522 - DNA, 570 bp, Homo sapiens
aagtgaagggtggcccaggtggggccaggctgactgaagtgagtagtgggggtgccagaccagtgtatctcctagctatggactaaataatacatggggggaaataaacaagtattcatgagggtgaaaatgtgacccagcaggaaaattacaactattttcaattgacgttgaataggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaac

SEQ ID NO: 4523 - DNA, 984 bp, Homo sapiens
gcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccat

SEQ ID NO: 4524 - DNA, 1936 bp, Homo sapiens
tgcggctgctaccgtcgccgcggagaaattgttggatctggcagtctaggaatgaggtgacttcatcaatgctcctaccccgagttcttgagacagacctggaccgatcccctaccttgggtgtgcactcttgggagaacgaggggcggagggtccgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctga

SEQ ID NO: 4525 - DNA, 894 bp, Homo sapiens
gttagcccagagggaaagaaagaactggggcgatccggtaggtaaaggagggaacccccattcattttctacctttggggctcctcttctgcatgaaggtataaagggagattttccttgtctctccctcaaaatgaagaacacatgtaaatccttgtttttcctggtgaggcaggggaggccatagccacaatgcttaactgcatgcatctaacatggggctggttttaaccccagcgctctgacctaaactgctcagctcccggaaattccaagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaa

SEQ ID NO: 4526 - DNA, 1532 bp, Homo sapiens
gatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctcttgtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctccc

SEQ ID NO: 4527 - DNA, 832 bp, Homo sapiens
aaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggaga

SEQ ID NO: 4528 - DNA, 618 bp, Homo sapiens
acatttaagaaatacattggttcagtccagaaaggcaggacaacccgacgcgaggcagggagcttccaggttatagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgt

SEQ ID NO: 4529 - DNA, 9646 bp, Homo sapiens
gagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaaccataaaagataaccataaaagaatataagttatggtatattataaattcttaatttagaaatcgtgcatcagtagttaggcattgtggctcatgcctgtaatcccagcactttgggaggcagaggcagaaggattacttgagctgcttgagcccaggagtttgagacgggcctgggaaaaatagggaaactccatttacacacacacacacacacacacacacacacacactgtgtccatgaacttgggaggatgaggtgggaggattgcttgagcccaggggttcaagtccaacttgggcaacatagggagaccttgtctctaaaaaaaaaactaaagctaaactacaaactgtgaggcaatatctgcaacatttataactagtaatagcttagtatcaagaatgtatgcagaaattctacaaaccaacaaaaaaggacagtgtcacagaaaaacaggcaaaagactgaaccaggccttccacacaattagaagtgcatgtgggccaataaacattaagaggttttcatctctcaatcaggaaaacgtaaatcaagatgacaatgacatgttcaaattcattcgattggtgaaaatgaagaaacacaaagtcaagttttggagagggttttagtcattaggatcactcacatattgctgatgggggtatcaattggtatatccactgtgaaaaaccattcactagaaaagttgggccaggcccagtggctcatgcctcttggctttgggaggccaaggtaggaggatcacttgagcccaagagttcaagaccagcttgagcaacatagggagaccacatctgcacaaaaagatttttttgaattagctgggcatggtggtgcatgcctgtggtcccagctacttgggaagctgaggtggaaggattgcttaagcccaggaggttgaggctgcagtgaatcatgattgtgccactgcactcttaccttgggtgacagagtaagatcataccttaaaaaaaaaaaaaaagtatacccatgggtcagcaatttcacttttcagtatatacttgagaaatgcttgcacaggtcccccagatcacacatataagaatgttctggaataaattaaaatgtctatttttaggaaggtgtaatgtgttcacagaatgggtgattattacatggcagcaaaatgaatgaataccagctacttgcagcacaataactcagaatgaaaaagcaattctgagaaaactatatgtgacatgatacttttcttataaaagtcaagaacaactaaaactgaacagctgtttaggcattgacatatgtgacaaaacttttaaaaagtaataaagttcaagatagtggttacctctggagaggtagaggaggagcaaatctatgagtaagtcactggtaatgttttagtccctgggttaggtggtgggttttggggtggttcatttgtcattaaaagtaagtacatgagctgggtgtagtggtgcgtgcttatagtcccagctacttgggagtctgagataggaagatccttgaggccagttcaaggctatagtgtgctatgatttcacctgtgaatagctactatattccaacctgggcaacgtagaccttgcccccctttaaaaaaattcaaaaacaaaataaatgcatggacaaatgaataagagagttatgcatggaacatcggtggtgtattatgaatcaagcattattactagctcagttatatgtgccttcattccaaaacaaaaaataaaaggtaagaaaattgttgaattgcatttgagagagaggaaaggaaagaattcaggtctgaatcttaggcttttggcttgagctattgcagtttattgagatggggaaatacatggtggggaaagtttgggtatgtgcataacagagacagaaattcagtgtttgacagatcaagtgtgaggtgcccactgagcatcaaagtggatatgttaagcaggtattggatgtacaaatctaaattcagtaaggtcagtccaggagaaaatttggggagtagttagccatgggatcagatgggcgctttagggacactttggagatgaagtacagcactgagccctgagttcctgtgacagagaagcagcctgcaaagacgaaaggaggagctgttaggaagagcaaggcaacagaaaaggaagaaccagcatgctgattatgttcaggagagtgtttctacgctgaatttaattgccaagattaccaattctaaagaagaggaggactcttggacaagtttttagaagttggtttggagctggggtgagagcctggcctaatggagacagctctggattgggagtcacttagacctacattctggtctaggtttggctcccaaaaactgggaaggttagttaggtggccactcctctctcttcatggtctctctcagcttgaagacaatttacagtctttgactaagcatccacactggaagaacaagatttggtttctgaacattgggtcttagtccttaaaataacttgcaacctgttacgtcttcacttactcccatcgccaccacaagaatcctgtgtgtttttgttttgtgcatccagtctaaaacgggtctgcttttattcataggcttttgttttcagtggtttttgttgttgcatttttccctagataaaatgttttttctataagacactgcttaaaagagtccaatgcagtatgaatttgtatttgtgtttaacttttgtgcttaacagatctgccatggctgaactctcagttgcttaagcaaaattctggggcttattctaggttcctttatttgtcattgtcactcccattccagttatcagcaaattccatcagctgtctccgagacatcttaaatctgtctacctccctccatgtccactgctaccactctgcccaagctattatcatctttcacctgaactcctgcactaatgtctgctgtccttgcatccactcctgccctcctacaatcactgacggcagccgcagggatctttataaaacgaaaatcagataatgtcacttccctgcttaaagccctttgagtggcttcccattgcacttagaaaaaaaaaaaaaaaaaaaaactggccaggtgcgatggctcatgcctgtaatcccagcactttgggaggccgaggcgggcggatcccctgaggttggtagttcgagacctgcttggccaacatggagaaaccctgtctctactaaaaacacaaaattagtcaggtgtgatggcgcatgcctgtaatcccagctacttgggaggctgagtcaggagaaacgctcgaacccaggaggcagaggttgtggtgagttgacatcacgccattgcactccagcctgggcaacaagagtgaaactccgtctgaaaaaaaaaaaaaaaaacccaaactcaatagaaaatcaagttttcatagtggtagttgttaacagagaaataacaatgaaagctttaaaaaactccatgaaaatttgcaaaacttaaaaaaaaaatgtagaagaggactaaacttgataaaatattaaaagaattgaaacccttcctaaaggcagcttctcaagggagcacaagttcacacacagtttacttttggaggaacgtctgaggtcatgaggactagattctagagctacaggtctcagggacagtctcgagggatacagggcccccatcaccacatccccagatttaaccgcagcagctcagcttttatctgtatctgttggagctctctaggaaatgtcaataccaaagcaaacccaaatcacaactagattagattactattcaagagaatgattctctaccgaaactctgcaaaatggggatatcaagagagttggaaaatgtaagacgtaaagaccataatcaggaaaatacgcatcatatttgttattcactgagagggaggaatttccacttaaatcctatttccagcagctggattgtgctctcagtggagtgctctggattctgattaatagagattttctagtcctcccagcaacttccttctcaattctcttcactttccgcagatctcggcaccagggttgcatcttgtgggctccattgtgttttcacacaatgtgctatttgtccttcacagtgttttggtttatttttctgtttgtccatcttgtttttgaacaattgccagcatttaaaaatgaggaaatctaaaatctgcatttcaagctgctcttttttaaaatgtgccgtttcgacaacactgagcccacagtcttgaatgacaacacttgggtggagctgagtgactccacctgtcgggtggctacacccttgctcagggtatgcactccatggtttgctctatggcccaccatcctggattgtctccctgacaccaaggctaagggacccactttactcacttatctgctgggccttggaagtatttcagttcggaaccccaattctaaccttagcttctcaggccattaaatgaaatctcatttctatgatgcttcctgtcacatcactgtgctgctgagaacatgaagtctgtgggtgaattggtggacgggatccagaatcattacttggcagtggattatagtgtgatgactcatttccggtggtctccaggagacttggctgggagcttctcttggagtctagggttagccagaggctacatgttttaggcatcttaattcatattttatctaaaggcatataaatccttaaaaaaaatcatttgacttcatccttgctccctacatccagccagtaaccattgctttgttttacatcgcgtgcttcaggctttactacagcctacctggattttgcagtagcttcttaaactgcttaaactttggatattgccccagccaacacattctgccacagagatctctctgagttaaatgggattgtatcatgccccacacccaagcagatagaaactgtcaatagatacacttagaatgaatatgcatggaatcaaattacattcagaatctaccactataggtagtgaatacaacaggatagcagaggctgggaagggtaatgggggttggggggtgggaggataaaggggttgggtaatgggtgtaaaaatctatagaaggaatatgatctgttgtttggtagcacaatagggtaaatacagttaataatttattgtatatttcacaataaaggagtggatttggaatgttctcaacacaaatgataaatgtttgaggtgatggataccccaattaccctgatttgatcattatacgttgtatgtttgtatcaaaatatcatatgtaccccataaatatgtacaactattatgtatccataaaaattggaaataaactaccaccatctttcttcagcctattttcctatctcctctcgcaccatactaggcacacaatctctgtacctgtgctgtcttccaagccattgctcatgttttaagaaatatacttattgtttaatatatcctgtaccactgtaggatgactgtagttaacaataatgtgtagtttcaaatagctaatagctggaaggaagttgttgaatgtttccaacataaagaaatgataagtgtttgagatgatggatatgctaattaccctgatctgatcactacacattatatgtatggaaatatcattgtgtaccccatgaatatgggcaattattatttgttaattaaaaaaataaaaaaaagacccacccactgtttaa

SEQ ID NO: 4530 - DNA, 551 bp, Homo sapiens
gttttcaaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacat

SEQ ID NO: 4531 - DNA, 2829 bp, Homo sapiens
cttgttctctgtagctttcaatcctttatacatagtgttccttttttttaaatactgtcttccccttgttcatcttccacctaactgttcttactaatccttcgtgattagcttagatatcaatttctccaggaaattgtccccactgatccccaagcctgggttaggttcccgggagtcctgtgtgccttctgtaacaccttgtgttttcctatcatagctctcagcagcctgtttacttgtctgaacattacttgagaggaagaatttttggctgttttattcactattgtctccccagctcctaacaaagaacctggcacacagctcaatacatggtagctattattattatcagcaccttcatctatcataattctcaaatgtctggttgttgcataaataactcttaagtatgccaagaagcttagagttaagttacaagactgacaagggcatgcattgtttcagagccatgtttgggacctttgtttttcacttattcaatcattttccctttttatactaggaactgacccaggagtgtgatgaaaagaaatcccagtatgatagctgtgcagcaggcctcgaaagcaatcggtccaaattagaacaggtaagaagagagtttttattttaacaatttagcaaaaactacctgtgtgtacacctgtagtcccagctactctggaggctgaagcaggaggattgcttgagcctaggagtttgaggctacagtgagctatgatcacaccactgcattctagcctgggccacagagcaagactctctctctaaaaaaaatgttttaaatactgcccgtgtacgcacattttcactacatcaatgtcaaaagattcccaaatctttatcatcatctcctaagctccagagatctttatttctttaatttgtacacacttaatttcccatctgtaccactcccagcaaagtacaaggctcattatctgctgcctggcctcccacagtaaactcttacctattctcttgcttctactcttgctctcctaaggtttattcttcatagggaagcctaagaaacctgtttaaaatttttgccacccttcattggcttcctgttgcacttaaaataaaatctaaccaccaaactatggtctacaaggccccacctgccttatgaacttcatgtccatgtgctctactcctcatccatggagcttcagccactctgaccttcttcctgagctttaaacaggccaagcttgttttcactttgggattttgcatgtactcttcccttctgcgtgatatactctgctcctaactcttcgccctcccttctccttttcatcactaggtctcagccttagtgtcactgcctttcagagatctctgatcacctgatgttacccactcttcttcccaacctggcccacccagtccctctatcacattctactgatggatttccttcatagcgcttatccccatctcaaatatccttcattatgtttccttgtttatgttggtttcttctacttcagtgaaagcagggaacctgcctgttcacttctgtgtcctcagcacttagaacagtgctggacacacagtaggtacttaataaatgtatgattgggccagatgcagtcgctcatgcctgtaatcccagcactttgggagtccagggcgggaggatcacttgaggctaggagttcgagatcagcctggccaacccggtgaaaccctgtctctactaaaaatacaaaaattagccaggcgtggtggcacgtgcctgtagtctcagctcctcaggaggctgaggcacgagaatctcttgaacctgcgaggaggaggttgcagtgagccaagactgcaccactgcactccatcctgagtgacagagtgagactctgtctcaaaaaatacaattgaacttgcaggttatagagtgatatgtgtattctctagaaaaagattatctcttattgtgctagaataaacaaagttaaaattgcagaagaggaaatgactctgatggtagtcctttgttgtacatctaaagtcatcgtcgccatatctgtctcattctttcgataatgtcacctatctaaaattatatattataggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggctta

SEQ ID NO: 4532 - DNA, 3377 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggttgcagggtcttcaccggtttgtggcccgggaaaagataatgtctgtgctgagtgaacggggcctattccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccctagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcacagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 4533 - DNA, 2291 bp, Homo sapiens
ggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatccca

SEQ ID NO: 4534 - DNA, 565 bp, Homo sapiens
gaatttgaatcctgtgggccgttgaatgtggctgctcgcggtcggcgtgccccgacgtacagcgggccgggaaaagtggcactgaggctctggaacttctgcccagctctccttgctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgc

SEQ ID NO: 4535 - DNA, 1010 bp, Homo sapiens
cagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggg

SEQ ID NO: 4536 - DNA, 2193 bp, Homo sapiens
gaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttgggg

SEQ ID NO: 4537 - DNA, 1134 bp, Homo sapiens; identical to SEQ ID NO: 1979

SEQ ID NO: 4538 - DNA, 1134 bp, Homo sapiens; identical to SEQ ID NO: 1979

SEQ ID NO: 4539 - DNA, 1029 bp, Homo sapiens; identical to SEQ ID NO: 4489

SEQ ID NO: 4540 - DNA, 1522 bp, Homo sapiens; identical to SEQ ID NO: 4483

SEQ ID NO: 4541 - DNA, 1716 bp, Homo sapiens
gaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatc

SEQ ID NO: 4542 - DNA, 577 bp, Homo sapiens
aacgaaggctgctgggttcatagggaggagggcagtttggggcccgagggcgaaagagtaggctcggggtgtctggagatagcacccataagagcggtcttgcaggcgccgggggcttgtgggcgcgtggattagggcggaggtatcagggatggcaggacaggtgccccgagaactggttgatctttgatcttagattctgcctgccttcttccccgtctcaattgtagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggct

SEQ ID NO: 4543 - DNA, 1522 bp, Homo sapiens; identical to SEQ ID NO: 4483

SEQ ID NO: 4544 - DNA, 2718 bp, Homo sapiens
aaagtaattttctgaagggaagctgcagaatatggaaaacatatattggagctacatggatcatgtcaagttcagactgtaaggagtagatgcagtagtgaagctgtccatctcaggtgaattgaaaaagtaaagaactacaaaatgccatcattccctctctgtgttgatttctggtgaagctcagaggatgagtaagagatacttacagaaagcaacaaaaggaaaactgctaataataatatttattgtaaccttgtgggggaaagttgtatccagtgcaaaccatcataaagctcaccatgttaaaacgggaacttgtgaggtggtggcactccacagatgctgtaataagaacaagatagaagaacggtcacaaacagtcaagtgctcctgcttccctgggcaggtggcaggcaccacgcgagctgctccatcatgtgtggatgcttcaatagtggaacagaaatggtggtgccatatgcagccatgtctagagggagaagaatgtaaagttcttccggatcggaaaggatggagctgttcctctgggaataaagtcaaaacaactagggtaacccattaacccaggagaaatcaagtgatcctcaaggctgatgacattgaacatgcgcatagaaacttaactcaactcctgaggtgatcttgaagatttttataccacttgaaagaggcgctcaatagtctatttccaagggatttcatggcctcttcttgaaatcaagactttttaaaagtcagacatgaacttgcatgtcatgaagatttcagcagatttgaactgtgttcaacttgtaaattgttaaaagaatttgaagtcactgtctgaggagctggtgaagagttgtttttttcagggtgatgttagagacagtcaccttttgagttattggctccagatgtgactacttttcttgtttctgcaagctgtatcccaagtgcactgtccttctgtcctggatgtgttcctgggtcctatgttcatttgctagtgggactacacatggctttaatgacatttcctttgagaacttttcctctggcatggtgtagactgagacaattttatttatatcctaatcttggagctcagaaagcctacatgttttaacatcttaaagttgcttttgttaaaggaatggaaatatatatccattggtaataatgttggcaagtaatagttatctgaataaatcaatcatataagaatgtatagacaagctgacatatttccctaaggctaacaacaccctgctgaagctctttgtcaaataggtagtagttagaactggattgccattttcattatataatactttgtacctctagagcactctccctttctgtttttttttaagtgagcttttctttaattttttatgtttacttattcccttcacagaaatcagcagtgagcagtcaagttaatgggtagccttcagtttcaaaaaaattgacagggatgcatgtgagtttctgatttcttagcttgaacattattcacttagatttcttccagtattttttaaaaaactgtcctatctcattttaaaagactttcttttgcttgatcccaatgactgtttgaatgcttatatatttgttcaatctgttgatagaaaaaattgttcattttcctcagtctcaaatttataaatatttgcttacagttttcctattcaaacaatttgttaggccaatattttgtgacatttttgtagcgattttaacgtttatggttttggttctacaggaaagtcataaatatttaaaggccttaaacatgtatgtactttttttttctaagttatagaatgtataattttgtactacatttattttgtttcatttgtgatatgaagggagagaagaaagaaaagtgcatagccattctgtaacaatattgtgtaaacctatagtttgaaggaatgcaaggagaaggatttctgtgttttactcattttaggctgttcagaagatgcttcaaaaattgtcctgttagaatttccatcatggaaggtggtatggaagaaggtatggaaatactttgtattctaaaaactcactgacgtggtcagttagacatacgttggtttccaggatagaggcccatatatcctggggagctttggtctattagtttgtgacaatattcaaaggccaaaacactactcagacactttcctgggaagagcaactaaaaatgtaaaattggttaaaaataaaatctgaaaagtatgtatctcacattgaactaaaatccactgtctcataagttcatggaatgaaatggctttctgcctccattttaatcatgcataaaatgaattagatggctttgagtggattttcacaatggctcaagactatatgaaattataaaaaaaaagttgccctggggtttctgcatcaattagaatatcattaatttctttgtaaccaagtgaaaaactatactttttggaaattatgaatttgtcctaggtttgtttgagatttgaaattatacatcatgcttctcattttttaaactatgttctttaaatcaacactggaaactctgtattatatacaagtgtaatacatgcatataatagaaaaaaaacatggaatttcaaatatactaactagattatccccagtagattaatgttgtgactattcagaaaaggtgaataaaattgggatataaaatgg

SEQ ID NO: 4545 - DNA, 2840 bp, Homo sapiens
gagcttcccggctgctttgtttacctaagcaagcctgggcaatggcgggcgtccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcggatgggagtgacccgattttccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatccaggagatactgtacggtttgaaagaaaggtaatcaaatactcagaaaaagtttgttgatgactt

SEQ ID NO: 4546 - DNA, 3377 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgacagcctcacagccaggaccccatcagaaggggaggcagggactcagaggcaacaaaagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 4547 - DNA, 5900 bp, Homo sapiens
gcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccatgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctagcaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttattgagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggt

SEQ ID NO: 4548 - DNA, 1029 bp, Homo sapiens
gttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctg

SEQ ID NO: 4549 - DNA, 1134 bp, Homo sapiens; identical to SEQ ID NO: 1979

SEQ ID NO: 4550 - DNA, 776 bp, Homo sapiens
gcgttctcctccgtcctctctcggttccccttgattcctgcggggtccagggacccggacagcttggggacgtccgcagagcctgggttcgagttctttacccttatcatgaagttttccctcatccccagctccacttgctgggcagagttgttcttgcggaggctggcaacgcgtcagtcgcaggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctcc

SEQ ID NO: 4551 - DNA, 539 bp, Homo sapiens
aaactggcaaaattattatattaatcaataggcttgacttgaagaaccacattttcttgttggtcagtcacttgctaatgaactgacatgctctttcctatttgttttctgctccaagtgattggaggggctgttatattcaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacaga

SEQ ID NO: 4552 - DNA, 530 bp, Homo sapiens
aaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcat

SEQ ID NO: 4553 - DNA, 932 bp, Homo sapiens
gaggcgcggagcgaagtgaagggtggcccaggtggggccaggctgactgaaatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggt

SEQ ID NO: 4554 - DNA, 1621 bp, Homo sapiens
aattttcagaagtttcgtatggggatggttttatataaattcaggtttttcccacaataataaatgtatttagtctcagtgctcaatagaagagatttctaatagaaaaggattcaaactgtgaaaccatttctcttttaatgtttcacattcctgttacagatttgttctcttgtgactctgttatccataatatggacagttcttgagtcctaacattgagaggttttcccttagtgcatagagggaatgagtattaattggagaagcttaaagtattgccactttagcactgaagattgggatgagaggaggtgaaacctcactagaaaaagggacaatgttagtgtggcccttcctgatcatgtttaagaaaagtcatgaaaatggtgaactagtgtttccaagcatattggaagggttgagtgtatactgtctgtcaaagacttccagcatttccaggtcctagagaggaacaagactggtaacctgcctatctgtatttttaagaacccaggaggaaagctttataatagaacattatttctgtgtttatgtataaggggttttttgtttttttaaagacaggatctcactccattgtccaggccaagtgcaatggcacgaacctcatagctcctggacttaagtgatctgcctgcctttgcctcctgagtagctgggactacaggcatgagcccccatgcctggctaagtttgtttttttgtttgtttgtttgtttgtttttgggggggggttgttttgttttttgtagagacgtagtcttgctttgttgccaggctagtctcaaactcctggcttcaagtgatcctcctgcctcagcctcccagagtgctaggattacagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattgctt

SEQ ID NO: 4555 - DNA, 1898 bp, Homo sapiens
ctccgctgagctttcgccagtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatc

SEQ ID NO: 4556 - DNA, 3609 bp, Homo sapiens; identical to SEQ ID NO: 4517

SEQ ID NO: 4557 - DNA, 675 bp, Homo sapiens
agttgcatcttgggaattactgaataatctagtgactaattttgaattttaggactgaaaaattttttctcctttctgcctccctcccatccccaaattagctttctaaaaaggaagattagtgtgtttgagatgtcagccttgcttttgtgagctgatggatgctctgaagggacaagctcaatttgtttaagggaaatgtaccaagtcactgaaaatgtggtgaaaggtgcctaagcaagccttttttgtgtgctgctaagagactgggcaagatgctcagagcacagaaaactcatattttagtggcttttcttttttcatttttataaagacgcttattcaccttggagaaaaagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaat

SEQ ID NO: 4558 - DNA, 581 bp, Homo sapiens; identical to SEQ ID NO: 1925

SEQ ID NO: 4559 - DNA, 1134 bp, Homo sapiens; identical to SEQ ID NO: 1979

SEQ ID NO: 4560 - DNA, 2710 bp, Homo sapiens
gtaactctacggcctagcaaccgttgccaaggagctcgactctgggagcggtctagagcccgggcgcctcctggggggtggggaaacggtttcgtgaggagaatttgagttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggcttactgtttttcttaatctcttttaaaaaaactttagaagaatcttttaggaactaatatctcttgttctgaagaaacatttatctgacgttcagcagttcctacagttttacttcagtttatttttcttctgtaaaatgcaagaaaatttaatattttgactaacatgtcttttctgtttgtatcatttaaaggcaaataaacttggtacgtatttc

SEQ ID NO: 4561 - DNA, 563 bp, Homo sapiens
gtacgtcacaccgtagagggacggcgcgggaggaataaatttctctgtgattggttggtgaaggttttcaaaccggagctgtgggcgcggcgctgctctgccgttggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttc

SEQ ID NO: 4562 - DNA, 1522 bp, Homo sapiens; identical to SEQ ID NO: 4483

SEQ ID NO: 4563 - DNA, 2674 bp, Homo sapiens
tgtttacctaagcaagcctgggcaatggcgggcgtccctcccccagcctcgttgccgccttgcagtttgatctcagactgctgtgctagcaatcagcgagattccgtgggcgtaggaccctctgagccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatcc

SEQ ID NO: 4564 - DNA, 1522 bp, Homo sapiens; identical to SEQ ID NO: 4483

SEQ ID NO: 4565 - DNA, 2586 bp, Homo sapiens
ccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttct

SEQ ID NO: 4566 - DNA, 609 bp, Homo sapiens
gggcagcgcgcgaggaccaggccgaggaggaagtggcggcggcggcggcggactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgag

SEQ ID NO: 4567 - DNA, 3796 bp, Homo sapiens
agagagagaagcaggaccgtggggtgggagagggtgtcaggaggccggacgtcgcagccggggcctcgcagtgcttttggggacgtctggtgctggggcccggcctggagactaagggaattcggggcactgggggcgtttgctggaccagcgctctcgacggttgcgcacgccagccagctctcagtgttgaggattcggaggccctgccggtcccccgcgagtaaaccttgtttatacgcatcctccgtggctttttttaaacccgtagtttattatttccaccaattcggctcgaatgctgaaattttaacagtagttaaatctcactgtgaaggcgttgccacgtttaaacaaatctcttttaatgaaagatggaaggttggggcgggtttagaatgaaaagatgctctacgtggctccgcgttcctcctgagagagatacccgggcaaccttgattaactctggactgcagggaagtgacagtctttgaaatgcctgagtgggatttaaactgaaattcgagtgtcctttgtatttaaaacccggatatttttctttcacggttgacatttttcatgtaccgcaaaaatccgagactcctatttaaaccggctgtggtaacagcggtggtgattaactagggtcttagtttgcaaacaatagggataaggtttagttccaccgccctgccttttcgcctccctcattcattggccaactgggttattatggagtctttttggaagtaatccactaatgctttgagcatctgtttctttgggttttattgttttgggcttttttttttttaatttttaatgatgaactatctgaaatatggaactctgtctaacccagtagtaaagtcatgccttctggaatggtttaaaagtgtgccataaatgtaaactataaatgggaactttaaatgtgtacaagttttacatctttattaaaaatcgtcagttttgtgtagcttaatacgaaaagatattttaagttccttttaaggttttaacaccaggatattgtaccatttaaatgtataaatatatttttaaaagtaggacttcataataatcagaataaaaacattccttcatccagtgctggctattccagcacccccattcttcctgctattgaacttttaagtgttagccaggaagaatagacttaaatactcggtgtttaggatagttaaaatatgagcatttttcatatagtgtctttgtaacagagacattggctatacttctctaagcctttctgctcatttcatatgtgctgtcaacaaatggtaatttttaaaaattgatcgctatatcctaatctctttatttttttctacctgaattattttcattggatttttgctctttcttaaatcagtgagtttcagaatttattgtgtatacactaccttgaaggatttgttcaacaatgctgattcctgcacttcagatctcagattctgaatcagtaggtctggaggatggcattgaacagtctgcatatttaactgaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaaataattacatctaataattatagagagtccttaccatgcaccatttgcttggaatttattgagcctattccaagttataacatattacgaagtccttgttgtaagaacgcttggtttcatagagactgtttacaggttcaagcaataaatgcgggagtgtttttctttaggtgtacaatatgcaataatagtgacatctttcagaaagagatgttgagaatgggaattcatattcctgaaaaagatgcttcctgggaattagaggaaaacgcttatcaagagcttctgcagcactatgagcgttgtgatgttcgaagatgtcgttgcaaagaagggcgagactataatgcacctgatagcaaatgggaaataaagcgctgtcagtgttgtggttccagtggcacacatttagcctgctcctcattacggtcatgggagcaaaattgggagtgtttggaatgtaggggtattatctacaattcaggagagttccaaaaagccaaaaaacatgtattacccaattctaataatgtggggattacagattgtttgttggaagagtcatcacctaaattacccagacagtcacctggatcccagagtaaagatctactgaggcaaggcagcaaatttagaagaaatgtatcaacactattaatagagttaggattccaaattaaaaaaaaaactaaaagattgtatatcaacaaagccaatatctggaatagtgccttagatgcattcagaaatcgaaactttaatccttcatatgcaattgaagtagcatatgttattgaaaatgataattttggaagtgagcatcctggatcaaagcaagaatttctgagtctcttaatgcaacatcttgagaactcatcattgtttgaagggtccttgtcaaagaacttgtctctaaattctcaagctctgaaagagaatctttactatgaagctggcaaaatgcttgccatttctttagttcacggtggtccttcacctggtttcttttctaaaaccttgtttaactgccttgtttatggaccagaaaatacccagccaattttagatgatgtttcagactttgatgtggcacagattataatcaggataaatactgcaacaactgtagctgacttaaagtcaataataaatgaatgctataactaccttgagttaattggatgtctcagacttataacgacattaagtgataaatatatgttagtaaaagacatacttggctaccatgtaattcagagagtccacacaccctttgaaagttttaagcagggtctgaaaacccttggtgttttggagaaaattcaggcttatccagaagcattttgtagcatcctgtgtcataaacctgagagtctttctgcaaaaatccttagtgagctttttacagtacacacattacctgatgtgaaagctttggggttttggaacagttacttacaggctgttgaagatggtaaatctacaacaacaatggaagacattcttatttttgcaactggttgcagttccattcctccagctggatttaaacccactccttcaattgagtgtctgcatgtggattttcctgttggaaacaagtgtaataactgtttagcaattcccatcaccaatacatataaagagtttcaagaaaatatggacttcaccataagaaacactctaagactagaaaaggaagaaagttctcattacattggacattaaaatgtttccttgaacaaagagaagcttctttaaaagctgctattgataactctcttttatttcactaaccttttcatcatcactttgaacaaactagttagcttcttgacctaataaaatttatgatatgaatataaa

SEQ ID NO: 4568 - DNA, 6306 bp, Homo sapiens
cgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttatagtttttttttttttggttttgtttttatcttgttttcttggggttgccccctcttgtttgtgttgtgtgtggaaatggcgaactcggcaaatacaaacaccgtgcctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttactggcaagccatggaactgtagcacctagggtttttgggtgggagggttggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaattttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagcaaa

SEQ ID NO: 4569 - DNA, 501 bp, Homo sapiens
agtcgcctccggaggaaggaagaagaggacgccgggcgcgcagcatcatgcttgggctagtggccccatctcaacatggctacttggaacagcttgagctgtgtgctgtgactgaactaatctgattaaagtgaccaagaagtccgggcgcagtggttcatgcctctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgccta

SEQ ID NO: 4570 - DNA, 833 bp, Homo sapiens; identical to SEQ ID NO: 3444

SEQ ID NO: 4571 - DNA, 3244 bp, Homo sapiens
actccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccgcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgca

SEQ ID NO: 4572 - DNA, 2434 bp, Homo sapiens
ttggcggggaacgaaacagagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacagctctatattctgtctccaggagaaaatatagtgaaaggagaatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagtgggaaaaaatatacagaggagaagcttcgtaaaggaactccagaatgtagtcagccctggaagatttactctagaaaaaccacaacgcagagtcagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttct

SEQ ID NO: 4573 - DNA, 760 bp, Homo sapiens
agtcgcctccggaggaaggaagaagaggacgccgggcgcgcagctcggtgctgattatcacaactgtttggtgacctacttcactgacctgtgaggattccttcccttcagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattca

SEQ ID NO: 4574 - DNA, 580 bp, Homo sapiens
tgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcag

SEQ ID NO: 4575 - DNA, 4108 bp, Homo sapiens
cgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaa

SEQ ID NO: 4576 - DNA, 537 bp, Homo sapiens
aatagccaatagttatcttttctgctcctctccctcctcccaccctcctgcgtcagctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactgaaatgctgtgtttgcaagaaaaatggtgcttcaattggatgtgttgcaccccgatgtaaacgaagttatcatttcccatgtggacttcagagagaatgtattttccagtttactggcaattttgcgtcattttgttgggaccatcgacctgttcaa

SEQ ID NO: 4577 - DNA, 9570 bp, Homo sapiens
ctgggcatccacttgacagccggcggcgctcgcggccctcagcatgttccgcgaggcgagggttttcctcccgcctgtgggctgaggcggcggcggcccccgaaacgagatgcacctgacgggcgcggcttagaggacgcggctggcgggaagtcccggcagccagcgggagggctttcgttgccgggccgccgccgcctcccgtcgccgccgcgggcccgagcgggagcggcgggtgggcgccccgacatggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcagggggaggattgattggaagaaaaggctacataggcacactggggaaaaatgacacaatgatgtgtgcagtgtatggatggactgaagagatggctttttctggaacatccacaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcagggagtagtaagaggttccaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtaggtgattcagcagacatgtcagctacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagccttttttctattgggaaaatttgtttagatgtgtgccactccataggtttatttccaaaatgaatgagcccaactccatttgtaaaaacttgtcagttagaattcctttttttagtggattagggctgaattcttagatccttatttcttttcactttaaatgctgccaaagatcactactcatcattcaggaattcgctgtctagcctatctgtagtttcctgaagattgaaaattatgtagactgctatttaaaaatatatttttctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagcataaccagtgattgaacctggtagttttaaagctctaaatagctgtggctgaaggactgattatggggctaagaagcttgaaacgtaagttggtacttgttcatcagtggattctcctaaattaagccaaattttgaaatacatgactattaagtttctactcatgtatttacagtcagtcaataaattaaaggaggaaaaaaatccctgaacaacctgcccataaaaagaaaaatactctacatttgagcctgctgcagttttaaattttccctctgggtcaagtttgccagcttttggctacagagaaattatatttccattacagtgcaggtagaaactctgtaaccttaagcatgtaaactacatagaataaaactgtttccactgcatttctgtccttcaaagtggccaacctgattaagtcagccttaatcactgctgctgtcagtttcacgactaaaggtcatattgactaagtagtcatcagctgaccacctcgctgtatcagccagcaacgaggggaaggtgaagaaacatgataggccatatagaatctgccctatgtttacttttttaacccagataattatttttgtgtgcagtatctaagctcctgattgtgtaacctgggacttctggcaccttttgttccattcattttatgtataaaatgcatgccaaagcacactgtgccctctggtacccttgcttccaatcgccaaccatgctcatttccttcctttttttgtggtccctttttgtggtgatcattttaaaccacgtcatccaacaaatgttttatggtcaaccttagcttgttcataagccatagcaactgaaagattaaactcttaaatatgtgtctgggcagtggctattaaatagcaaaaaacaatcagattttagtattttattatttccttgtaaaatggctgaactaaattaaacccttgtttcccatttgttctataatttatagtgaaactgagaacaaaactatctttataaatgatagctaaaagtatttccagatatttaaacaatttaaaataaatttcttctgcagagatgcaaagcatctcaacactggaatgaacaaatgccttaaattcaatggagtaaacctttagaatgaagaggaactgtcatttcacccaagccgaagacaacagccttatgcacttgtgtgctctgtctttgctgcttctcgtgtttcaagcctttcctgtgggatcagcacagcaaagtgcaacttaccaaatggtttaatgactggttaattctttcttctcccaatggaaaagcaatggcaacacaacagtagactgctggcttgacaatcttaaacgtgagcctttgcacatgtaggtttatcatcatttgagtatacgactaagcaagtcaatgaactttttttttttttttagcagtttaatttggtcctgagaatgttgcagtctttattaccccttttgcattaatccacttttctaaccaccttttaagctttaatttttaacactatacaccaagtctttgaaatcagtgatctgttatttaactctaaagcatttgacacttcttgccttaacagttttaaaaaccacacacaaaaaaactctgtaagtaatacagtaggccaaaagtttcatcctatctatcttgcagtttacctatctgatctgatctctgtaattatagttctgtcatttaaaatatactatttaaatctaatttttacatttcaaaaattatcttcagtagtaactaagtatattttctgtggattctgagaatgttatttttcagaatgtgagaatatatatgtacatttataatcttgtgactttaaagtctgttttcagatacagtatgtaaatacttgtaaaaaaatttgtataattttgtgataatgtagtttcccaaaaaaattatttagaaggcattatgttattagtaaatgagagcactgta

SEQ ID NO: 4578 - DNA, 3369 bp, Homo sapiens
tgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataa

SEQ ID NO: 4579 - DNA, 4173 bp, Homo sapiens
tcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagcccccgctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctgg

SEQ ID NO: 4580 - DNA, 1225 bp, Homo sapiens
ctttcttggggtaggtgggcccttccctgcctttctcttctagctttgggatctcaggaggaggagaacccaagaaactgtggaatgatgtgaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaa

SEQ ID NO: 4581 - DNA, 2218 bp, Homo sapiens
ggggcggaagaaggcggggagggagggggcggcaccgccggtcggctccagtcgcctccggaggaaggaagaagaggacgccgggcgcgcagctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaa

SEQ ID NO: 4582 - DNA, 2635 bp, Homo sapiens
agcaagatggccgccgctgaggaaggctgtagtgtcggggccgaagcggacagggaattggaggagcttctggaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtggaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgctgacgtggctttttttctgtggctcccagtgggtctacggaccttggctgacatatgttggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagac

SEQ ID NO: 4583 - DNA, 2543 bp, Homo sapiens
ctgcggtcagagggccgaggcctgggggcgagctggggtcgtgcagtacagcctctttccggcaaatcacgcgagatttcgttcacccgggctccacagggtcagtgacgcgcgagcggctcccgcgactgtggctcccgaagctgcttcgggccccagcggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctcaaaagtttgttttattaattgtactcaaccctcgcagaacagtaaaactgaagattatt

SEQ ID NO: 4584 - DNA, 1014 bp, Homo sapiens
ttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtgcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacag

SEQ ID NO: 4585 - DNA, 5095 bp, Homo sapiens
agctggaggctgcgtgggatccggcggcggctcccgagcgcggcggtgcggccttccccgccccctccctccctcctcccccgcccgcttccgcccggcttattatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgggacagcaaggaaggggggaagctggtgtcctactccacagccagtcttggggttagaggaaccctgagaaatagagtaggtggtggcagctcagaagagaagaaacaggctgaatacctggcacctggaagaagaaggaatatagtacacaggggagttggcccaggacagagaagtgggcctagtttaaaagaggcttgaggcccacatgggggcccctgacattttttttttttaccagtacatctaagctcttgtagatccaatttttagtggtggaaacattacttgaggaggactcagagaagcattgtcatttggattgaaactgaagaggctctgggcaactcaccagaaatctaagggacactgtgttcctgaaagtaagtgttctacaccacgaccctctcagcttcttccttcctctctctgaattctcttctcttttgattttggctctaagttaaacctaagagctctaatttctctgttatctgttattttcctagtggtttctgaaattcagggtagaatctgtgtttgtatagaacagtgtggaacagggtattgttactagagaagatattgattgcatcacagaatattaatatttttcctctctggtaatgttaaaaaaacaagattaaaggactgcagaacggtgttgagaagcaaaagtttcagtagttggaagaaataattctccataattgacttattaatgaacagggtaatttccagagtaaggttggcaagtactaaagccaagactggatagctgcagagcagaaggatgcagtttgctaatgatttgtttgtgtgacgcacagatgggatttgaatcctttgggtcagactgacctttgaactgattctgcctcattgccaaatgttaggccaagtctaagccattctagacatttgaaaaacttttttctttttagacctgcagagaagattgagtccttgttctacctttgaagtcttctttttttcttttttcttttttgagataagatctcattctgttgcccaggctgggttgcagtggcatcatccaggctcactgcagcctcgaactcccaggttcaaggaatcctcccacctcagcctcccaagtagctgaaactacagatgcacaccaccatgtgtggctaattttcttattttttgtagagatgggggatctctatgttgcctaggctagtctcaaactcttgagctcaagtgatcctcctaccttggcctcccaaagaactgggattataggaatgagccaccattcggcccctttaaagtctttattggcaatataattttttttctttaaataatattaagttcaaattctttatgcaacagaagcccatttcctttggctatatccatggtaggtcatgtctttctagagaacgaagttacattcatggcatgtatttcaaaataaaatgatttgttgtagcttcagttcctcaagttttaattttattttagattttggggtacatgtgcatgtttgttacttgggtatattgcagagtggtgggattgggattccagtgtacccattacccaaatggtgaacgttatacccaacaggtcatttttcagcccctcactccaaaattttttacattgtgcttttgtgagagaaacagtagtaaatgtcaaactgacaggaaattttttaaaaggaaacaaaatgccacggtgacacattattttcaagatgctgcacagtctttatatctgaagtttcttttctttcttttcttttcttttcttttcttttcttttcttttctctttttttttttgaggcagaatttgagacagtcttgctctgtcgcccaggctggagtacagtggcgtgacctcggctcactgcaacctccacctcccaggttcaagcaattctcatgcctcagcctctgtggtagctgggattacaggtgcccgccaccacaccaggctaatttttgtatttttagtagagatggggtttcactatgctggccaggctggtctcaaactcctgacctcaggtgatccgtctgcgtcggcttcccaaagtgctgggattacaggagtgagacactgtgcccagcctatctgaagattcttataaggcaagaaatgtcccaaatataaatgcaagaaactttaggaaattaaggatcattcttggctggcccagtggcccacacctgtaagcccagcaccttgggaggctgagacaggaggatttcttgaggccaggagtttgagaccaacctgggcaacacagtgagatctcgtctctactaaaaattaaaaaaattagctgggtgtggtggtgcatgcctgtggtcccagctactcaggaggctgaagtgggaggatcccttgagccccagagttcgaggttgcagtgagctgtgatcataccactgcactccagcctgggcaacagagtgagaccttgtctcaaaaaaacaaaattctgagtcatcagagaaaatgaaatattaaatattaaggatagtctgtatgagggtgataatcaatgtgtgatgattaatttaagactggtgtcttattggtacttcatctagtagtggacagttacttaatattgcttaattcagatagcaaatatttagaaatgaaaatgatagaattattggtttgggtttcaaactgtggtctaaatggttcataccaggctttcaaatgtaacaggtaatgttacattttgttagaggatattataacagtcctttaggtttctcataggtgttattttagagagctataaaaaagatttcacatagtagaaagagtgctagatgttacactagtatgattttggtaacctgggttcatatctcatttcatatcaaccatttcaatattcagcattcagcaaatgtttattgagcatcttatttaagggctgagttggatactagacatacagtggtgagcaaaatggatttttttgtttctttaaaattttacagttttgcaaattagaaccgctttaactgtaccaagctctatatgtgaggtttagtgttagtagatctttcctttatgtgtaggctgaagaggtggaacttcttcattaaaaatatatgttgtttataactgaacacagtattattattatggttaggtaaaaagagtgagttatttcagcttcttttaaaagtaagctataaaatccacattctgaaagaagcttaaaccaactatcatctggtagaaatcttttcagcatcgttgttttcttgtcatacttgctttatgtcttcaaatttgaggtttggcactgattcttctagacttttggtgtaggaatgggagaaaaaaattgaggaccatctacataagtcctttttaaagaaatgcatggttcctgagccgcctcctgtctatctgaggagcctttctagcaaccatttagttgttcagagactccttattctaggagatttcttacttgtttgttttttgtcctgtaagaggactcacactggttaattgtatatgggtaaattttacaagtgattattagtgtttgtgtagtctggatatcagagtggttttcaaagtgtagtctgagggacactgagagtccctgagatctttttagttgaagctttctatgaggttcacactgtttttataataatttgaagatgttatttgcctttttcactgtgatggtgcagaggcagtgatgggtaaaactgccagcaccttagcatgaatcaaagcagtggcaccaaattgctatcttcattgtaatattcaccaccatgtacatgcatgcagtaagaataatgtcagtttgaattaagaatatccttgaagcagaaaaatttactaattttattacatctcatatttttaaaaatattctgtctgaccaaatgggaactacacataaagcacttctactgtataccaaagtacagtggttaagggaaagcacatgtgtagtttgtcttgcaagcagagctagtctttttgtcatagagcatcatttttacttgaaagactacctgaaataccatagttattcagacttggatatttagcatatattttcttgaaaatgaatatattcaaaaaatatatcacttcaaggaaaacacttgatactatatgttgccagtgataatcattcaagtgaaaattagaatttttgaaaatttgtagcaacaatgagctttagagtttctgtgtataaagacttttctgagaagattagtggtggtatcaatgaatataatttctgatatttcaccatgaaatgtgtcagcatttggaagctacgcataactcagcaaacaaatggttcctagttaccgatgtatgattttacaaaactgtaatgggtaatccatcaaagtacaaaataccaacagattttaagggaacactgaaaacttcattgatgtggtttcagatttcatattgcaactaacctttgagaaacaactgtgtttttatgtagtatcaaagaataacacctatagttatctgaaaatgctattcaactacttacctcttttcaactgtatatctgtgagagtccagattttcttaatatttttggaccaaaacaacatattgcaacaaattgaatgctgagatagatgtgacaatccaggtgtcttctactaaccagatgttagaggtttgcaaaaatatacgatgccactcttcatacaaaatatctttgttttggaaaataataagtttttaaaataaaaatatgtcattt

SEQ ID NO: 4586 - DNA, 4662 bp, Homo sapiens
caagcggcggcagcggggtcctgtactcttgctgtggctgggcggctagttcaagttgccatagctgcgagtctggggagagcacagtcggttgagtcgctgcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaattttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatgcat

SEQ ID NO: 4587 - DNA, 1711 bp, Homo sapiens
cgaccctcagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 4588 - DNA, 411 bp, Homo sapiens
aagcacatctacaatcaaggagaggggcaggctttaccttttgaaggaagaagtatgaaagtgtatcactgactgatcaagtagagctaaaaaacattcccttcaatttaaaaaatgttcccgactcttaacaccccagttgagaactactgatcttagatgtattaaagtaaaatgaatgaaagtaaacctggtgactcacagaaccttgcttgtgttttctgtcgaaaacatgatgactgtcctaataaatacggagaaaagaaaactaaggagaaatggaatctcactgtacattactactgtttgttgatgtcaagtggaatttggcagagaggcaaagaagaagaaggagtttatggttttctaatagaagatatcaggaaggaagtgaatagagcttctaaactg

SEQ ID NO: 4589 - DNA, 3236 bp, Homo sapiens
gcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctccctgggtggccccgcgcgccgcttttgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccaggtataaggaaggaaaatatggcggcggcggcggcggcctgaggaggcggcggcggcgcgggaagctgcttcgcggagatcatggcggaggcgggagcagggcagtgacgggagccccgagttcctagcgctgcggggcgggaggctacgaagcgctgcgcggccccctcggggctgccgggcgccgggctcgccaggcctggacaatagcgccggggagccggaggcgaggaaaggcggcggcccagagctcggtccctggagcgggccatgcaggcggcggcgcggccccgcggcgcccagcggcggcagtgaggccggggagccctccgctcgcgggcgccctcacgcctcgcccctcgcctctccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattcta

SEQ ID NO: 4590 - DNA, 869 bp, Homo sapiens
cagagaaggaaggatcttctcatgcacagaggcaacaaatggcaactttctgagtcctcatctataaaatgagcataataacatcacctacttaattggatttggtgaggattcactgggtgagttcatgcaaagcgctgagaacaggaccccccgcccccgtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttgga

SEQ ID NO: 4591 - DNA, 3851 bp, Homo sapiens
gcggtcagagggccgaggcctgggggcgagctggggtcgtgcagtacagcctctttccggcaaatcacgcgagatttcgttcacccgggctccacagggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctcaaaagtttgttttattaattgtactcaaccctcgcagaacagtaaaactgaagattattgtttctgaatgttttggcttatgattgtctacacactgccaatatacttttgtatgcaacatttgtaataagtagattcaaactgtgttggtaatcagcctccccagttttcgtgagtggcccttttttgttacttttcctggaccatttcatcgcctgagggggtttcacttttctctgtatgttgctaactcccaaatctccatctgtatttctgacctctttcttgagcactggacctttacctccaagtaaatatcctcaactctggattgcatcttatactctgcttttttcttttcttttcttttttgagatggagtcttgctcagtcgcccggcgtgcagcggcacgatctcggctcactgcaacctccgcctcccgggttcaagcgattctcctgcctcagcctcccgagtagctaggattacaggcgcgtgccaccacgcccggctaatttttgtgtttttagtagagacgggttttcacggcgttacccaggatggtctcgatctcctgacctcgtgatccgcccaccttagcctcccaaagtgctgggattaaaggcgtgagccacggagtccggcctactctgcttttctaaagtggaattatcttcctctgaaatgtttctcctttattttaaatcaccattagtaatttgtgtacccaaacctgtcatcaaggcttatctttaaccttgaaaatgcctttttaaagagaactcctttaattcccacggttgagtctctcattcttccgcacgcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagtcccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctc

SEQ ID NO: 4592 - DNA, 361 bp, Homo sapiens
tcacaactgtttggtgacctacttcactgacctaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactcc

SEQ ID NO: 4593 - DNA, 576 bp, Homo sapiens
ctttctacctccttattcagagaaggaaggatcttctcatgcacagaggcaacaaatggcaactttctgagtcctcatctataaaatgagcataataacatcacctacttaattggatttggtgaggattcactgggtgagttcatgcaaagcgctgagaacaggaccccccgcccccgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctac

SEQ ID NO: 4594 - DNA, 821 bp, Homo sapiens; identical to SEQ ID NO: 1137

SEQ ID NO: 4595 - DNA, 3834 bp, Homo sapiens
ccgggcgcgcaggtgagcggcagccggggtggctgcgggcgaggggcggcccccgagaagggctaggggctcggggcgccggcgggccgtcaggccttccggatggggacgcgacgccatgcagctggctgggccgagaggggcggcaggctgcaggggccccgcgcccgtgttaagaggggtctgggggccggtctggccggcctggctctcccggctcccctcagacctcggcgccccggaaacgcacacttggggctccgccgtctccgctgggaggactggagcccttctcgagcatccccgcccgcacccgagcattgaccggtgcccattgtcagcaagttcttcggcccccgcctcattcaggtattgtttctgaggcagcttcttcgttgccgtttgcctggcggtttgcagagcgcttctcgcatacgctcgcttaatcctgggtgtgtcatagcaacgatcaggaaacttgggttttcgaagcatctgtgggcaaaactgcattccttgagaaatgctaaaggctcctgaccccgccggaacctgggtgaagaacttgggctgttctggcagtctgcgcaatcgtatttctgccttttgggaggtaactcctgcagaggcggagccggctgttaagttaagtcaacctcgaaaggcctgggtgcgggtgttctatggcccagaagccagatgtccttcgttagaatcccggcactgacacctattagccgcccagccactttgagcggccactgccctccccgagcccacgttgcctcctttgccgagtgtgagcggattaaaatcttatgtgcatggatttgttgggaagattaaatgatatgagtagggcacgaacctgaacagagtcctgaaacatacagctgtttaatcacagtgaattaagacgaccagtttaaggagtgaaatgtttactgtctcggcaactttcatgaatgccttggaaatacagcccaaaatattggtagatggagaaacatctggttcccctttccacaaccaccttttcgttttagaaccagggtactttgtatgcagttgcttggattgttgatttccctcattctttgtagactcatctcaagtattctcagtaacttagattcccttgctcttcattcagaaatatttgttaaggtccattaaatgaaagtcaccacagttgatcatgtgaacagtgtcaagaatcaggccgaaccttcaaggagtttatgttctaaaacggaagcatggtggtacctgcttgtggaggctgaggcggaaggatcgcttgagcccaggactttgaggctgcataattgcattgacgctatccatagagtgcctgcaatttcaaatatcagaaaggatcgtacgagctatgatcatgccactgcactccagcctgaaccacagagcaagaccctttctctcaataaagtggaagtttgttcatttattcagtaaatatttattgattgccttctgtgtgccaagcactgttctaggtactgggattacagcagtgaacagataaatctcttccttcctggaacttacattttattgaagggaggagacatacaataaatgagtgaataatatgctttgtggtgataagggctgttggaaaaacgaaagcaatgtaaagggagtggagatggggaagagagaagggacttgccatttttatatgagatgctcggtgctgattatcacaactgtttggtgacctacttcactgacctgtgaggattccttcccttcaggtactggattcttgatctttctgcatcatcaagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattcc

SEQ ID NO: 4596 - DNA, 5064 bp, Homo sapiens
gtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcat

SEQ ID NO: 4597 - DNA, 4485 bp, Homo sapiens
agtgcgcactacgcccttgctggcgccgggatcctccctctctcgctcctccctttctgggctgcaccgctcacgccttcctgttagtccgagctgggagaagttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacccatcagacctctctcagatagccataaaagacccttccaagtcaattttgaccacatctttgcttgcactttatggaggatgaaaccatcaaaccaaatcaacgttgctgctaatacaagagtcttagaggcagcaaattaaaaatttgaacatttgtttgtgaagaactataacaggacatgaaaggtgttcttttttaaagtgttcagaaccctgtggaagtttcgtgcagtcttcagactcaaatcttcgtcttcacccccggggcaagctcagtgactattatatggtgggtgtgtttccttaccagcgtgagtatgagtgcccagacttccccagcagagaagggcctgaatccggggctgatgtgccaggaaagttacgcttgcagcgggactgatgaagctatctttgagtgtgatgagtgctgcagtctgcagtgtctccgctgcgaggaggagctccatcggcaggagcgcctgagaaaccatgagcggataagactcaaacctggccatgtcccttactgtgacctctgcaagggtctcagtgggcatttaccaggtgttaggcagagggcaatagtgaggtgccagacctgcaaaattaacttgtgcctggagtgccagaagaggactcattctgggggtaacaaaaggagacaccctgttactgtgtacaatgtcagtaatctccaggagtcactggaggcagaagagatggatgaggagaccaagaggaagaagatgactgagaaggttgtgagtttcctcctagtagacgaaaatgaagaaattcaggtaacaaatgaagaagactttattagaaaattggactgcaaacctgatcagcatctgaaagtggtttccatttttggaaatactggtgatggaaagtctcatactctcaaccacactttcttttatggtcgtgaagtctttaaaacctccccgacccaggagtcctgcactgtgggagtgtgggcagcctatgacccagttcacaaagtagcagtgatcgatacggaagggctcctgggggccaccgtgaatctaagccagagaacacggctgctgcttaaggtcctggccatctcagacctcgtcatctatcgaactcatgcagaccggctgcataacgacctcttcaaattccttggggatgcctcagaagcttatctgaagcacttcaccaaggagctcaaggccaccactgctcgctgtggcctggatgtccctttatccacactgggccctgcagttatcatcttccatgagaccgtgcacacccagctactgggctctgatcatccctcagaggtgccagagaagctcatccaggaccggttccggaagctgggccgtttccctgaagcctttagttccattcactacaagggaacgaggacttacaaccctcccacggacttttctgggcttcggcgtgctttggagcagctactagagaataacaccacccgttctccccggcacccgggagtcatcttcaaagccctgaaggcactaagtgaccgcttcagcggtgagatccccgatgaccagatggcgcacagctccttttttccagatgagtatttcacctgctcctccttgtgcctcagctgtggggttggatgtaagaaaagcatgaatcatgggaaggaaggagtgcctcatgaagccaagagccgctgcagatactcccaccagtatgacaaccgagtgtatacctgcaaggcctgctatgagagaggcgaggaagtcagtgtagtgcccaaaacatctgcttccactgactccccctggatgggtctcgcaaaatatgcctggtctgggtatgtgatcgaatgtcctaactgtggcgtggtctatcgtagtcggcagtactggtttggaaaccaagatcctgtggatacggtggtgcggacagagattgtgcatgtgtggcctggaactgatgggtttctgaaggacaacaacaatgctgcccagcgcctgttggacgggatgaacttcatggctcagtcggtgtccgagcttagccttggacccaccaaggctgtgacttcctggctgacagaccagatcgcccctgcctactggaggcccaactcccagattctgagctgcaacaagtgtgcgacgtcctttaaagataacgacactaagcatcactgccgagcctgtggggagggcttctgtgacagctgttcatcaaagactcggccagtgcctgagcggggctggggccctgcgccagtgcgggtctgtgacaactgctacgaagccaggaacgtccagttagctgttaccgaggcacaagtggacgatgaaggtggaacgctcattgctcggaaggtgggcgaggccgtgcagaacactctgggagccgtggtgacagccattgacataccactaggtctggtaaaggacgcggccaggcctgcgtactgggtgcctgaccacgaaatcctccactgccacaactgccggaaggagttcagcatcaagctctccaagcaccactgccgggcctgcggacagggcttctgtgatgagtgctcccatgaccgccgggctgttccttctcgtggctgggaccatcccgtccgagtctgcttcaactgcaataaaaagcccggtgacctttaaccccagccccctctccgagtccttcacaattccttaggttctcagggttagaaacagtcttgcgaggtaggccctcctcccagtcacctgctgtggtgtgtgtcctctcctctccgcatccagggccactttccctcagtgggggtgagcctggcggcaggcccgaaggtgtggacccctcagggcaggggaccttgcaacttatcgcaaaggggaatgaacctgaatccgttgcatttatttcagttaaaaataatgaatatatatgtgtatatctctctctcatatatacatatgaaaggcactcggggcgtatcgaggctgctgctggctgtgaagacttcgcacagtctcctccgcacagggtgaggtggcagtggcagcacgtcttcctcatgagccgagccaggtccatggccaccacgtggctggccccttcctctgctgctcttggagccttggaagcctctcctgtccttggctcttccctccatgcctgtcagctgcctggggagtgagcctccctggtccttcctgcctgaaacagcctgaagggaattctccctaggtctcctgggagtcgagtcccaattcttggcttaagcctgttttagtcagagaccacccaacttagcgtgcaggtcaccggagtgggtggagggtcagaggtcgggtcttcggccctgagaagtagaaatgcaggggccgtgctgtccctggtcccccagggaacagcaaggaaggaactgagccttctccagcagggcttcctgtcccgatgcttctgtctccactcggctttcccaaaaggcggcacccagctcctcaatcgaagcatctgcctcccacccctcggccccctcaagcccaccatctgcttctgagtgtcgcactaggattttcattgcttattttaaagtgtcttaatcctttgttcccagacacacaacccctctagctctcggaggggcgatcatgagaaaccttccagggaaactgagcacaggatgaactgttagttgtttttaaaagtctatataaatatttcaacagatcgtaaagaaaaaatttatctctttggtccttgcaagagaagtcaaaggaacttttgtttctcctcaagagcctggacatctctgtctgtcatgactggaaagggcccgttgtgctgaaatcctatcatcatggtggatttgatcttcagtggccaaacacgaattaaagtataattcttaactgaactggtgggtgggttgagctttagggaagtatatggcggtcattcctggtgcgcctatcggtgtgacatgagccctggagtgtgtcgtccctctcagccctgctcctcctgcctcctggggtccagtgactgggaccctactctagaactgtgtaccatccaattcgccatcataaaggaatcttcctgc

SEQ ID NO: 4598 - DNA, 1010 bp, Homo sapiens
ccaggaggggaaagggccaggaaagacaggctccagtgccgtaggatccaggcatgcactgtccgtgtttattgagcgcctgctgtatgctgggacctagcatgagaagcgctgtcatggggacccggaaaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccc

SEQ ID NO: 4599 - DNA, 4079 bp, Homo sapiens
cacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggtgaggcctgagagcgggaggggcccggtggggccatgtcccagacaccatccctgctgcctgctggctaaggagccgtgacatcacctggctgctccagccgcccagccctgccttaggggagcagtgagactccccacaccagaggaagggcccccagcccctgctgccagtgtgtgtccaggacttgggtgcgtctagaaacatatcagcaggcattggtgttctccctgggcaagcaggaagggtgcaggaggaatgagacacacccatcattccttagcccctcctaggacccagcaccctgcaggggctggagatggggacttgtcatcccagtccctgctttaaggagcccacaggctcatctacagccttgctccttagtccctggacaaatgcagcagctgccaagggtctgcgtaacccccaccaacccagtggcccacccctccccatacctctctctatacagactcagtattcaaaccagtcccgcccctccccaactccatcaccccacccacccccaggctgcatcaaatccagctgcccccagttccccaaacatgcccagcccagttcactggctgctcaaccgctgccctcactggtcaatctccccttcttcactggctgtcactgcccatcctttaagacgactcagtttctccaacagcccctcctctgagaagccttccctgatacacacacacaccgtttcacacaggctgggtggggtgccctcctctgggcttcctgcggcctccccttttacagtgcatatcacatcctatcatcctctgcatatgaagctgtcacctctgggagggcacagcccatggttcacatgcctcaggggcgccaagcccagggcctgggacagagcaggactgggtgtgtaaaaaagggtgagagttggactagtgagccaggcacatccagagctgtgagcagctatgcagactcactcctctgacacccagagcagaccagtcctgagccacactcctggctttcaagatggtgcatctataataagcagagcccaggcctgggagacaggaggcttgagttctggccccagccctgtactagcttgctgtgtgaccctcagcaatccctgccccactctgggactcagttttcctgcccacacaggctgactatggctaatcaatttaataactgactctctggggagaaaacaaaagctctgattttagcttctgtccatttccatggtgtgagtcctccatggccaacttcaacttggcatcactgaatgtggagttggaaagaagtgtatgcagtcggctctccctggcgggtgtgagccagctccagcacacctctgttcccatcccctcccaacaccccggactcccacagactgtagggacatggacactcttggtccaagcctggcccaggcatcccgtacttcctgcttctaccttaggggttcctgatgctgagccaggcagagtatggatgaaacggaccacccactgtttgggagacggaagcttcggaggggggtcccctcagcaccacatctgggatctggggagggcaccaccctctgccccctcccagtgcctcctccgcacaccatgccttggggggtgggcacccttccctggggaggggaagcccagagctggacagtcactagcaggtggatagtgccctgggaggcctaatggaggacaaggagccctgaggcagccactaagacggagggagtgggccgggcttttcccctcctggaagaaatgggcggtccccgtgaagctcttgacaggagcccggcctcgcctaagccctagccaccagttgccatcacggtctccgccgagccgggatcctcagccgcttcccgcgcaggcctgctgttcccaatccggccacaagggggcagccccgcgcgcagcctctctgcctgcagccctgagccccggggaaggcgaggccgctccgggccggagcttccagcgcctgctcgcccatttatgggaggcgggcgctatccccactttacagccggggctcgacgaatcaaggccacacaggcagtgggagcaaaggcaaagcccggcaggtgtggggctgggtccctaggggtggaggacggcgggcgggcgccctgctcgtgctgcgagtgcccagccccagcccgcaggcgtcgcctcgccttgcccgccctgctcatgccgggccttccccacccgactgcgcccagcctccttcacccggtcccctcccgctttaccaatccctgccccacgcagctcctcagagccccagggctcttgcagccctaaggggctggactgtgttgcccgcccgcactatgggatgcccgggcgggctcgcacctcccttcttatctgtgctgccctccgtgcccagcattgcgcctggggtgcagggaactcacctggagggagggagggagggaatgaatgaatgaatgaatgatggggagcctgtggaccagcagccaggggacgcgccggctcctctttgcagggactccgagacgcgccttaattcatctcccagaactgtcggcccagctgggaagccaggcagggagggggacgggccccccgcaggctcgcggcagagacgggaaaggcgcaggtgccggactcgcagacagcttggcgcccgccacccgctatccatccagggaggggcctgggccgggagagggcgcctgaggagacagggccccgccgtgaccacaggcccctcgcgtctccgcaggacttcatctgcgtgtcgtacctggagcccgagcagcaggcgcggacgctggcgtcgcgggcggacacccaggcccaggcgctgtgcgcgcagtgcgcggagaagttcgcggtggagcggccgc

SEQ ID NO: 4600 - DNA, 2731 bp, Homo sapiens
gtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttct

SEQ ID NO: 4601 - DNA, 6683 bp, Homo sapiens
cccgcgcgcgaggccgccggcggccgctctgccgtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcagtcccgcagcgtggacaagcagcatgccgtcatcaactacgaccaggacagggacgagcactgggtgaaggacctgggcagcctcaatgggacgtttgtgaatgacatgcgcatcccggaccagaagtacgtcacgctgaagctcaacgatgtcatccgcttcggctacgattccaacatgtatgtgctggagcgtgtgcagcaccgagtcccggaggaggcactcaagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacagaggcagcctcttaccgcacacccctgtatgggcagccctcctggtggggtgaggacgatggtagcacgctgcctgacgcccagcgccagggagagccctacccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccagggcctcccggtgccgggctcccctgggggtcagaagtgggtgtcccgctgggccagcctggctgacagctactcagacccgggcctcacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccaacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggtgatcttcgataacctgatgctgaacccggtgtcccagctgtcgcaggccatccgtgagaacacagagcaccttgccgagaagatgaagatcctctttcagaacacagggagagcttgggaggacctggaagccaggatcaacgccgagaacgaggtgcccatcctgaagacatctaacaaggaaatcagctccatcctgaaggaactgaggcgggtgcagaaacagctggaagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcaca

SEQ ID NO: 4602 - DNA, 756 bp, Homo sapiens
gccacagtcggattcgctgccgcagcagccgccacccccaggagccgccgggaccctcgcgtcgtcgccgccgcggcccagatccccacaccatgccgtcggagaagaccttcaagcagcggcgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctgtgcctcccaggagacgttcgggatgaaattgtcagtgtaaaaccagaaaaaatgcatctcttctagaattttttaaacccttaccaaggaaaaaaaaagggatgttaccaactgagatcgatcagttcatctaatcacagatcatcaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaaaaaaaaaaaaaaa

SEQ ID NO: 4603 - DNA, 6166 bp, Homo sapiens
gcggccgcgcggcggggccccgggaggcgggtcgctgagcggggcgcgcggccccgaggatgcgggagcgggagcgggagcagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaataattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccaca

SEQ ID NO: 4604 - DNA, 3069 bp, Homo sapiens
gcgggcaggggcggcgagtgcgcgggcgctcgccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttc

SEQ ID NO: 4605 - DNA, 2635 bp, Homo sapiens; identical to SEQ ID NO: 4582

SEQ ID NO: 4606 - DNA, 2529 bp, Homo sapiens
atgacgtcagatcgcccccgcccgccgcgcagcttccccgagcgagaccaaaacaggtggaatccgggctggagccggagctccggcggcgcgggtggcggcacgtccctccaggtgggtggctctctgggtctggcgactcagcgctcctcagccttgccccctggtgcccgctcgcgactgtcatcgccccatcacttctcgttgcagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaatgagtagagcatgaaggtagaacagtctatatactcttgtgacacatacaatccctaccttgtgctgccaagtaactcatttttgtgcaattctcagtataagccctttgtcgtttctgtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaa

SEQ ID NO: 4607 - DNA, 2776 bp, Homo sapiens
ggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctgctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagata

SEQ ID NO: 4608 - DNA, 545 bp, Homo sapiens
atcctttctacctccttattcagagaaggaaggatcttctcatgcacagaggcaacaaatggcaactttctgagtcctcatctataaaatgagcataataacatcacctacttaattggatttggtgaggattcactgggtgagttcatgcaaagcgctgagaacaggaccccccgcccccagtgaggagatgacacctagactgaagtagcagcagtaatgagctgacagcctcacatctacttttggtgtgccgtgaataagccatatgatcttaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtctt

SEQ ID NO: 4609 - DNA, 534 bp, Homo sapiens
acacaccgcccagcgctcgcacgacgggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctt

SEQ ID NO: 4610 - DNA, 896 bp, Homo sapiens
cggcgaggaaaaaaggcagttttgaagcatttagtggcaaaaggggtaggagacggctgctgaagtgtctactacattcaggggacctggaaggcttccagatatccgcaatgaacaatgaaaagaaattgtgaaagaaggcgcttccctcaagccggaactaatgaactcctgggtcacgtggtgcgcacgcgccaaaggcacacgataaaggaaaacgcgggcttatcgtggcctttaaaatccggcttgccaagacttccgccctcgatcaagatggtggttggacggccttcctaacctttacggggcctggcggtgctgacgcctgagctggtaggggtggagcaggtaggaaacagcaaatgcagaagctgctgcgcggaagtcggccatggactggaaagaagttcttcgtcggcgcctagcgacgcccaacacctgtccaaacaaaaaaaaaagtgaacaagaattaaaagatgaagaaatggatttatttacaaaatattactccgaatggaaaggaggtagaaaaaacacaaatgaattctataagaccattccccggttttattataggctgcctgctgaagatgaagtcttactacagaaattaagagaggaatcaagagctgtctttctacaaagaaaaagcagagaactgttagataatgaagaattacagaacttatggtttttgctggacaaacaccagacaccacctatgattggagaggaagcgatgatcaattacgaaaactttttgaaggttggtgaaaaggctggagcaaagtgcaagcaatttttcacagcaaaagtctttgctaaactccttcatacagattcatatggaagaatttccatcatgcagttctttaattatgtcatgagaaaag

SEQ ID NO: 4611 - DNA, 770 bp, Homo sapiens
ctacgcctaggagggcccctgggtgttcacccacccccccggggggccccatcctgggccagggtccgcttcctcgagggaaggggcgaattcctggaaggtctccttccgggcgcagttgcaatggattgccttgggggtgctgaaccctgctgggggtacagagacgtttccgaaactcagcggctcggtcgcccccaaaggccaggcggaacacacgcccacaccgcggctcccttcccgaagctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgag

SEQ ID NO: 4612 - DNA, 999 bp, Homo sapiens
tttcccgtccctgcgcgggaagtggctggacagcaccgccaccacccgcgctgtcgtgggcctcctcgccggctccgtgtaggtcatcctgtgttccagaggcatcgttgttcgagcagaggaatctcgtgaaggaaagtgggccgagtggattgtacagcctctacaatatgccgaaaaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatg

SEQ ID NO: 4613 - DNA, 3338 bp, Homo sapiens
aagaacaaattcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatg

SEQ ID NO: 4614 - DNA, 649 bp, Homo sapiens
gcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatcccc

SEQ ID NO: 4615 - DNA, 878 bp, Homo sapiens
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgaga

SEQ ID NO: 4616 - DNA, 4803 bp, Homo sapiens
tggaggggagaaagaggaagggctgcggccgcggaaggctggggtcggtgaccggccggttatctctggctcggtggtgacttagggtctgggtctccgcagacgatttgtgtttgggcaaggcattcgtctaccgacacacccacagcctacagtgagggagtgtgggtgaggggatttctctcccacttccgactctccctagagtctcaggatgggggctgaggaccgaggcgtgggagtgcgatttgacaatggagtgatgaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtc

SEQ ID NO: 4617 - DNA, 1595 bp, Homo sapiens
ctccccagggccaggcgtcccgcgcacctggtactcggccagcagctccttggacaggcgactgcccgagccccccatcgccccgccgcgcgcacagctccgccaactcgcctcgagacgcagacaactttctcacttccgcccttgggccgcgtcactgcccggtccccgcggcaaccgctcctggggccaccacccccgggcccgccccctcctaaaagctgccaggcgttcccagccgggtttggcaggcgagctgccggctccaagcggtcctaggctatttactgaggacccactggatgtcaagcattgtgcatagttttcttcgattgttgcaacatcccttgcgagtttctggagcagcagagctgaaggaacccaaacttggactgaagtgactctactaaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcatcccagatgctctgccacaatctccctttgatgctgcactctgctctgcctggaagcagcgggtggagctggggctgtttcgctaccgtctacgggagctacagacccaaatcctccctggtgctgtgggtttcgtggctcagctgaatgtggagcgtggtgtgcagaggaggcccccgcagaccatcaagagtgtgaggcaggcatttgaccctgtacagttcaacttcaacaagatccggcccggagaagtcctcttccgtttgcaccgggagcctgatctccctgggactctgctgcaagaagacatcctggtggtgatcaacgtcagccccctggagtggggccacgtgctgctggtgcctgagcctgcccgccagctcccccagcgcctgctgccgggtgcactgagggcagggattgaggctgtgctgctgagcttacacccgggcttccgtgtcggcttcaacagcctgggaggcttggcctcggtgaaccacctccacctgcatggctattacctggcccacagactgcccgtggagcaggcgccaagcgagcccctggaccctggaggccatttgcatctgctccaggacctcccagctcctggcttcctcttttacactcgtgggccagggcctgacttggagtccttgataagcagggtatgtcgggccactgattatctgactgaccatgagattgctcataacttgtttgtcacccggggagctccgccgggaaagacatcaccttcctcagccctcacaggggtccgagtaattctgtgggcccggaagtccagctttgggataaaggacggtgaagctttcaatgttgccctctgtgagctggctgggcacctccctgtcaaaacatcccaggacttcagcagcctgacagaggcagctgctgtggccctcattcaggactgtcggctgcccccatcccaggcagaagacgtacaggcagcactggtggccctgatgtcccaggaagagcaataatacttctggatgtattt

SEQ ID NO: 4618 - DNA, 8456 bp, Homo sapiens
gcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtact

SEQ ID NO: 4619 - DNA, 550 bp, Homo sapiens
aagtcgcgaggtgcatccgcttcggctgcagtaggtggtggcggcggcagccctgggtggggtcccataggggcatctgagaagtcactggagctagcgtttccgggaaacctggagactcgctgagtggcgggggtcgtcggctgcccctctgcccagcaagggcttttctagatgttatcatcaggcaatcgctgcacctgtcgcagcccccaagccacctcttccagaagtaaccataaccttgcttccttcttaggctatttactgaggacccactggatgtcaagcattgtgcatagttttcttcgattgttgcaacatcccttgcgagagtttcactcctgttgcccaggctggagtgcaatggcatgatctcagctcaccgcaacctccgcctcctgagttcaagcagttctcctgcctcagcctcctgaatagctcggattacagtttctggagcagcagagctgaaggaacccaaacttggactgaagtgactctactaaggtcagctctatggctcttccacatgattcaaacgaaactt

SEQ ID NO: 4620 - DNA, 581 bp, Homo sapiens
agcaaaaataaaggacgcgaccgccgcagcctctgcggagccgggctcgggtcgccggagccgcgccccaccccgccagctccagagccacgtacggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagc

SEQ ID NO: 4621 - DNA, 411 bp, Homo sapiens
tgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggaga

SEQ ID NO: 4622 - DNA, 1083 bp, Homo sapiens
cggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagaactgcccagctcccgtggcttgagtctcagcaagtgttcagtctgaagcccttcctgctgcccactggcatagagttgaccccagaaaatccctggggttcttcggtgagctgacagagcccagtgggcaggcacccagagcaggaggagatgtagccaagaacaggatccacactatcccctgtttggacccaggctcgcatggcagcagccatcacccgatgtgaatgttctcagctcctggagcctacaggagaaaacccagattcctcaatctgctcattaagatgtgacacccactcacatcatctcctcagcccattgcctcaacagttcacgctgtcaacagttcacgctcccgtgattccagctagttccctgagcatagggggctattttgtgtctacatgcctctgcacccccacctctaggtcctctgattgactgatttctagtcagcctttaaaacttcgctgcctcttctccaccacccccaatccccaccccagagctggctgtgtttcctttcttctctgttgctgtagtactctgtacattttatgcctagcaccttccacaattgtgattctatcattgtgtctccctcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatac

SEQ ID NO: 4623 - DNA, 850 bp, Homo sapiens
catgacctcgctgtggccccggcagcggctgcggggaaagtcgcgaggtgcatccgcttcggctgcagctatttactgaggacccactggatgtcaagcattgtgcatagttttcttcgattgttgcaacatcccttgcgagtttctggagcagcagagctgaaggaacccaaacttggactgaagtgactctactaaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcatcccagatgctctgccacaatctccctttgatgctgcactctgctctgcctggaagcagcgggtggagctggggctgtttcgctaccgtctacgggagctacagacccaaatcctccctggtgctgtgggtttcgtggctcagctgaatgtggagcgtggtgtgcagaggaggcccccgcagaccatcaagagtgtgaggcaggcatttgaccctgtacagttcaacttcaacaagatccggcccggagaagtcctcttccgtttgcaccgggagcctgatctccctgggactctgctgcaagaagacatcctggtggtgatcaacgtcagccccctggagtggggccacgtgctgctggtgcctgagcctgcccgccagctcccccagcgcctgctgccgggtgcactgagggcagggattgaggctgtgctgctgagcttacacccgggcttccgtgtcggcttcaacagcctgggaggcttggcctcggtg

SEQ ID NO: 4624 - DNA, 5278 bp, Homo sapiens
ctgaggcgcagatcgctggctctcgacgcattactctttacgccttacatttctgtcttccttcctgggtcagtgattcccggaccctggaagagaagagggtggctaatgattaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaactggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtctttgtgtttcataattagtttttataaaaacagtttacattaaacatcttggaattcaacaatagtgatctcactcaaattgacatttgcataatttgacatttatattcattcagttatgactacttgcccttttcttcatattagtaaatgttacactgtagtagttgtcaatgttaacaggcttcaacatagtatgtgtgcagatggacgatggatttaaagagcataccttatgattaaaccgaggttatagaaggtcaggggagagtgaaggagtcagtgacctatgtctgccatcttactggggaaaagagcaagtagcctgtcttcctttaagtaagtagcctgtaatggatgtactactttgccactggaataccccgggtctgtgccaagggactgaagaagtgtaagatggggagaactgtatgtcatggagtcctcttgacgttcccccagatacaagtaaagcacaggtggatttctctatttttgaatactacatcagatttagatgcacgactacctgttgacttgttttataattgctactgatttttttaatgtaggcaaagctttgttactttgaaatttatttaataaaagtatttgtgacataa

SEQ ID NO: 4625 - DNA, 3548 bp, Homo sapiens
ggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtcaaagagccccctgaaatcaatttagttttgtaccctcaaggcctaactggtgaagaagtatatgtaaaagtggatttgagggttaaatgcccacctacctatccagatgtagttcctgaaatagagttaaaaaatgccaaaggtctatcaaatgaaagtgtcaatttgttaaaatctcgcctagaagaactggccaagaaacactgtggggaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggagcaacgtgaaatcctgcatgagattcagagaaggaaagaagagataaaagaagagaaaaaaaggaaagaaatggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgtggtacagagtcattcccagtcccctttagagctccttctctgttccatttccacaaagactcatggactttacttttattttgggagtggggagggaagtgaatatggctgttggatactatgctcatcctcaccttcctggagttaaaggttttatttaagttacgctggacacagttgagaattgtcccactcctctttccttgcttcatgtggagcattaacatgaaacacacatggttataacagcacttcaagtggaatcaagacctccacagaaagaacatttttgtgtgctttggttcagaaagaacattgttctttttttctcctgtttgctgttagagttgctgtagataaaaaggttctaaggttagaagagagatggacttcaaactgggagatggccccagcaggtctcgatggcttttattttccagctattattgggacaggaaagtagcgatgtattattaaggtacactgttgttgggtcttcctttcttcgttctagtctatttgggtgacttttattattatctgccccttgtagaaagaggtttcagctgtttttatataatagaagtatttctttgtaaattaggagacccagattattgtattaagtccatatacagtacatgtcatctttcacatatgaaggtaacccaccatcaactgagtatattgtctgttaaggattctgagagtatcattaggaagcattactgttactgtagaaaaacttttacactaaaaaaggaattaaattagttttcctgtggtaaaagacagacaagcaagacagatgtcctgatcagaaagatcataattatgtctaagaggaggggatgattgaagcgtatactgtccctttaacacaatatcattttgatcaaatcctttaacttcattctattttaaattcttgaacgtagaatagtaacaaatttcatctctttacaagtacttaataatgataggcaagctcatataacaaaaacatctgagtaacttaagcccccacggtttccagtagtttctccctgtgagaatccacagccctcacctcctacctctgtgcttctgtgtcagagtagggcagcctgcccagtgatctggcattcattagcagttggacccattactgtttctgcaccttttcacttcagtaaatgaattcctaggggtttccagtatagcaagctttactcccaacccagttcgtatatgatgtgtactgagacaggagatcgaaaggcaatgccaagatccccacctcccgccctacactgtcctcttccctattaatgtggcagtaaaagaacacagggctatcattttttggagcacctgccatatttcagattgtgtgccaggtgatttacaaaccttgtctttaaatctcaggacattcttacgagatgggtatgatcctcattccctagatgagggaactgaagctcagagaaggttatgtcctttgcctgagataagggagataaaaccagcattcagacccacctctgttgtactacaaagtgtgtgttcttgtcactatttccatacaaaaaaagataatctgaaactcaattttgtagtacttccttcttattcccaggacttcacttagacttttattagtttaattgaaacttgtgagccaaacaagagaa

SEQ ID NO: 4626 - DNA, 541 bp, Homo sapiens
agcagatgctggagctgctggtgctggagcagtttctgagcgcgctgccagccgacacgcaggcctgggtgtgcagccgtcagccgctaagctgggaggaggcggtggccctgctggaagagttctgggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgatt

SEQ ID NO: 4627 - DNA, 2023 bp, Homo sapiens
tttttgtgggccgggtgggtttcctaatctggtttcgtctgcctggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcgggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtaggcccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacagggtaaatacaaggagctgaaaaaatgaagaggtatttattagccagaatgcacctaaaatccaggccaacattaaatataatgcatatatgctatagctttacctatgctgaattcatctcatagaa

SEQ ID NO: 4628 - DNA, 5115 bp, Homo sapiens
acttctagggcattagacaagttgcccacagtcccaagttagtagcccaagttagtagccgagctaactcctcgagtaggtctctgtgaagcccagaggtcatgcttgtaactgctgtgctgaggccaactttgtgcggttgtttgcctatttactggggactcccatatcccaaaagcattgtcgatgcctctggtaaggtggcctccactgctgcctggtcttcaacttctgggacatgtgtatatctccttacgatccacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggc

SEQ ID NO: 4629 - DNA, 577 bp, Homo sapiens
ctgcggagccgggctcgggtcgccggagccgcgccccaccccgccagctccagagccacgtacgatggagtctccctctgtcgccaggctggagtgcagtcttgtgatctcggctcactgcaacctccacctcccgggttcgagcgattctcctgcctctgcctcccaagtagctgggactacaggcgcgcaccaccactactggctaatttttgtatttttattaaagacggggtttcaccatgttggcaaggatggtctccatctcttgacctcgtgatcctcccacctcgacctccaaaagtgctgggattacaggcgtgagccaccgtgcctggcctgaataatatcatcttaaacttttgggacttgccttaccagtcatcagaacatttatacatttataagcctattgtaatcaagtcactgttgtaagaatagacaagtggaccagaatagagaatccagaaatagatcctgttagtggaaaagactaatggctgaaggataaatcaacatggcaactatgattccaccagtgaagctgaaatggcttgaacacttgaacagctcctgg

SEQ ID NO: 4630 - DNA, 4741 bp, Homo sapiens
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctga

SEQ ID NO: 4631 - DNA, 647 bp, Homo sapiens
caaaaataaaggacgcgaccgccgcagcctctgcggagccgggctcgggtcgccggagccgcgccccaccccgccagctccagagccacgtacgaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctg

SEQ ID NO: 4632 - DNA, 4789 bp, Homo sapiens
ggctaagcaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggcgagaacgtcagtattctgtatgtaatagtgaagattctcctggctcttgtgaaattctgtatttcaatatggggagtcctgatcagctcatggtgcacaaagggaaatgtattggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaaatgtgtgtgcttggatgacaaggaaagatggagtccccagcagttgttgaaacacagctttataaatccccagccaaaaatgcctctagtggaacaaagtcctgaagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgcctgcttcagattctgaaagtgatattatctttgacaatgaagatgagaacagtaaaagtcagaatcagatggagtactgtgagaagagcactttacgagacaccattgaccagggactgtatcgagacaccgtcagactctggaggctttttcgagagattctggatggattagcttatatccatgagaaaggaatgattcaccgggatttgaagcctgtcaacatttttttggattctgatgaccatgtgaaaataggtgattttggtttggcgacagaccatctagccttttctgctgacagcaaacaagacgatcagacaggagacttgattaagtcagacccttcaggtcacttaactgggatggttggcactgctctctatgtaagcccagaggtccaaggaagcaccaaatctgcatacaaccagaaagtggatctcttcagcctgggaattatcttctttgagatgtcctatcaccccatggtcacggcttcagaaaggatctttgttctcaaccaactcagagatcccacttcgcctaagtttccagaagactttgacgatggagagcatgcaaagcagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaagggcaacttctcaatccgtacagccaagatgcagcagcatgtgtgtgaaaccatcatccgcatctttaaaagacatggagctgttcagttgtgtactccactactgcttccccgaaacagacaaatatatgagcacaacgaagctgccctattcatggaccacagcgggatgctggtgatgcttccttttgacctgcggatcccttttgcaagatatgtggcaagaaataatatattgaatttaaaacgatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggaaagaaattacagtatttatttgaaccataccatgttattgaaagcaatactcttacactgtgggatcccagaagataaactcagtcaagtctacattattctgtatgatgctgtgacagagaagctgacgaggagagaagtggaagctaaattttgtaatctgtctttgtcttctaatagtctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctgattccccagtttagagggccacaagctctggggccagttcccactgccattggggtcagcatagctatagacaagatatctgctgctgtcctcaacatggaggaatctgttacaataagctcttgtgacctcctggttgtaagtgttggccagatgtctatgtccagggccatcaacctaacccagaaactctggacagcaggcatcacagcagaaatcatgtacgactggtcacagtcccaagaggaattacaagagtactgcagacatcatgaaatcacctatgtggcccttgtctcggataaagaaggaagccatgtcaaggttaagtctttcgagaaggaaaggcagacagagaagcgtgtgctggagactgaacttgtggaccatgtactgcagaaactgaggactaaagtcactgatgaaaggaatggcagagaagcttccgataatcttgcagtgcaaaatctgaaggggtcattttctaatgcttcaggtttgtttgaaatccatggagcaacagtggttcccattgtgagtgtgctagccccggagaagctgtcagccagcactaggaggcgctatgaaactcaggtacaaactcgacttcagacctcccttgccaacttacatcagaaaagcagtgaaattgaaattctggctgtggatctacccaaagaaacaatattacagtttttatcattagagtgggatgctgatgaacaggcatttaacacaactgtgaagcagctgctgtcacgcctgccaaagcaaagatacctcaaattagtctgtgatgaaatttataacatcaaagtagaaaaaaaggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaaatttttttctaagaagctgtcctacaaagttgagctttgttagtttttcatgtgtaatatattataaatttatcttttgggatataataaatgctttcatata

SEQ ID NO: 4633 - DNA, 5052 bp, Homo sapiens
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggc

SEQ ID NO: 4634 - DNA, 4536 bp, Homo sapiens
atgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaactggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttc

SEQ ID NO: 4635 - DNA, 504 bp, Homo sapiens
gtgctggctgcgtatgcgtcacgggcgtcatgacctcgctgtggccccggcagcggctgcggggaaagtcgcgaggtgcatccgcttcggctgcagctatttactgaggacccactggatgtcaagcattgtgcatagttttcttcgattgttgcaacatcccttgcgagagtttcactcctgttgcccaggctggagtgcaatggcatgatctcagctcaccgcaacctccgcctcctgagttcaagcagttctcctgcctcagcctcctgaatagctcggattacagtttctggagcagcagagctgaaggaacccaaacttggactgaagtgactctactaaggtcagctctatggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcat

SEQ ID NO: 4636 - DNA, 2026 bp, Homo sapiens
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagctggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctg

SEQ ID NO: 4637 - DNA, 1790 bp, Homo sapiens
caggagtggcctccgacgtcactgtggcgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaagtttcatcttttaatttggccagtgtttccttcatgctaatctagatgctgtggctgattacttgcccaggatctcctgtggcagcctctgcttgttctctggcttggagtggatggggcagcctccagctcctgtggaagtaa

SEQ ID NO: 4638 - DNA, 2043 bp, Homo sapiens
ccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttctcttcacatttcagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaacatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctatactgttgctctcctgtcttctggctgaccacacagttcatgtattaagatacttctttaactttctcaggaatgtttctcttagatccagtgagaataagatggatagcagcaatcttgcagtaatatttgcaccaaatcttcttcagacaagtgaaggacatgaaaagatgtcttctaacgcagaaaagaagggcgtgtaccagactttatcctggaaaagataccagccatgttgggtattgatggtctctgtgctactccatcactggaaggctttgaagaaggtgaatatgaaactcctggtgaatataagagaaagagaagacaacgtgtaggagattttgttagtggagcactaaataaatttaaacctaacagaacaccttctattacacctcaacaagaaagaattgataatgaaacaaccaccatcggttaaatttgatccaaaaatattgcatctaccagcattttcagtggataagttataatttctgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatatgaccaccattgtatatgcagaccattgactggaacatcatgatctatctgcacatgactgtaaataacaactattggatgtggcacagatggaagctacataaacactctatacaatatggccaattcaccgggctccctgttagtcttgtgagcaattttaaactcttccacgattctttctctgctttggagtgtttcaattaattctccattatattacaatttacatttttattaagccttta

SEQ ID NO: 4639 - DNA, 1760 bp, Homo sapiens
gcccccggctcccggaggtcgacattttggtttccataggcaaagtcctaacaccacaattgacatagttaaaaaggggagacggtaacgtgtttggtagaggttacatatcttgctatagttgtttattttagttgctgagtgatacacagccctcaaagagtctgacattgtgcccatggttacacttgtccgggggagaccttgaatttggtgtggaagaaataacatcagtagttcagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttacc

SEQ ID NO: 4640 - DNA, 3705 bp, Homo sapiens
gtggtctcgcgggcgggtgacgtcatcgaggcgagagaggcggagccgtggacagtgggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccagattttcaggggctgagagatgcattggattcagagcatacccgccgcaagcattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctccagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgta

SEQ ID NO: 4641 - DNA, 1043 bp, Homo sapiens
gctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataa

SEQ ID NO: 4642 - DNA, 1641 bp, Homo sapiens
ggcgcgaggcctgtgggcccagcggtgaggcagcagctgggggcggggggagggcggacctagcttcccagggcaggtgattcgtcggccccggtggcggcggcgcgtgcgacggtcacctcggtttggggtccacctaaagtgggaagtctgttttcaaaatgacatctactccatgcctgtcttgtttccctaatgtactttatggaagttcttcacactactggagcattgacgttacttgttaagcagccttccacatcctagctcttttccaaggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 4643 - DNA, 1792 bp, Homo sapiens
ctcattttctcttgccgccaccatgtaagaagcgcctttcgcctccctccatgattctgaggcctccccagccacatggtacttgtatgcctagacagcgggcacagggcttgctggacacagaaggcaaggactcagagaatatccaccagatgaaagaatgactgcatgacctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactg

SEQ ID NO: 4644 - DNA, 1681 bp, Homo sapiens
atgctcagccgcgatggctggggctgccgggcgcgtccaagatcgcgccctgcggcggtttcccatcaccctgcctgtgggcgacgtgagtatctgcgagggtagaagccagaccctttcctcccacgtttaggtgccttcctcgcccctactcctgggtagaggaataacaatatttctcgaggcttcggcccaaggtcttagccttgtgatctagaatccgccatctgtgaggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagaga

SEQ ID NO: 4645 - DNA, 796 bp, Homo sapiens
cgcagatcatgggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccagacaaaagacctgtccgtgctgtaggaaagaggtgaaaaggaaaaaggttgtccacatgaataaactccggaaaaccattggccgcctggaagtcaagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggcctgcctgcctctgtgcctgcggccctc

SEQ ID NO: 4646 - DNA, 1116 bp, Homo sapiens; identical to SEQ ID NO: 1485

SEQ ID NO: 4647 - DNA, 4134 bp, Homo sapiens
ggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagaagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgcttctctgtggttgttcagcactttaggtagccaaggtgagaggattgcttgaggccaggagtttgagactagcctgggcaacttggtaaaaccccatctctacaaaagaaaaaaaaaaattagtgtggcatggtggcatgcatctgtgctcccagctcctcacgaggctgaggtggaaggatcaagtgagcgcaagaggttgaggctccagtgagccacgatcaccccactgtgctgtagcctgggtgacagtgtgagattctgtctcagaaaaaacaaagtataacattgctttgcttctgagtatactgttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgagtcactggattagcatccatatgggaagggaaattaacatggagtcatttatacagggactaaattgaatcctacctaccggaggcaagaacatgatttatcttccataagccttatcctcttcctccttattcctcagtccatatggatttgcttatgtatgacaactccaaggaatcttggaagagtagattgctaacgtttccacaattgtcaagtatattctgaggcagtaaacacctttttaggtacgtggcctttcactggttgtgaattggtatgcatccgtagtagtaagttcacagattcactgcagtgcaggaatgttcttgcatgccaaagactcaactgctttcaaagataatgtgggtgctagatgcagtggcttacatctgtaaccctgttagggtgaccagacccaacaccaggtcgtgggggtgacaaagtccagtggagtcaaaggattgagaaaaagacagtttgagagagaagtaggaccagcagaccatcgggatggtggaggctgtgaaggccgtgagctctgggagcccacactatttattggtaatccaacaaagaaacagatggtgagaatgtgaaggtcagaagggcaccttgcattaagcacatgatttacagctgtgatggtttagcatttgctctgctacttgagatgatggagagcaggttcttttaactcaagttacagtcgatcctgggagagcaaggagccagcaagtctagacattccagagccacaggccctggattttatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggaggtagaggctgcaatgggccatgatcacgatcctgcactccagcctgggcaacagagagagacagtccctggcccactgcccccttccctggcccagtctcaaaaaaaatgaggctgggcgtggtggctcacatctgtaatcccagccaaggctggcagatcacttgaggccaggagttctgagaccagcctggcttacatggtgaaaccccatctctactaaaaatacaaaaactagccaggcatggtgggaggcacctgtaatcccagctacttgggaggctgaagcaggagaatcactttaacccgggaggtggaggttgcagtgagctgagatcacaccactgcactccagcctgggcggcagagcaaaactgaaaaaaa

SEQ ID NO: 4648 - DNA, 1809 bp, Homo sapiens
atggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 4649 - DNA, 2204 bp, Homo sapiens
accagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtttttcacgactgaaaacaacatagcaaaataagccaagatgtctgtggatccaatgacctacgaggcccagttctttggcttcacgccacaaacgtgcatgcttcggatctacattgcatttcaagactacctatttgaagtgatgcaggccgttgaacaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgcttcctgaagataaatgtaaggagacaccttatagtgaggaagattttcagcatctccagaaagaaattgaacagttacaggagaagtacaagactgaattatgtactaagcaggcccttcttgcagaattagaagagcaaaaaattgttcaggccaaactcaaacagacgttgactttctttgatgagcttcataatgttggcagagatcatgggactagtgattttagggagagtttagtatccctggttcagaactccagaaaactacagaacattagagacaatgtggaaaaggaatcgaaacgactgaaaatatcttaattgctcagtagtcaaaaggaggagcctgtcaaaaagtagaatcataaggactgttcaaaccataaggactgttcaaatcataccagtgactgttcaaaccaaccatactttttattagatttgctttgtcaactctttcttgtattctgtgttttcctcttttttggtccactttgctgaggtatgaagtgtactactttgaactaggctgaagcatctgagtcttctaataagtgggaagggatccaacaaagaagccatgaccagttaaagatatttgcagagttacaccttggtcataagtcctttgtgaccttgattattttggcttactctttggatgagaccagacaagaaaaggattaaacgggtggctcctttaatattattattattgtttttgagacaaggtccctttctgtcacccaggttagagtagatttcagtggcacaatcttggctcactgcaacctctgtgtcctgggctcaagtgatcctcctgcctcagcctcccaagtagctaggaccacaggtgcgtgtcaccatgcttggctaatttttttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagacaaaaaaagcagaacccactggagtagaaaaggaagcatgtagcatatactcagtagtgaaatttaattttactgactgttaggtatctatgccaatttgttttcatacttcagttggttttggaatctgccttatacctaatatttatttattcacactcataagcatcaaatatttaatgccctcagtgggaaatttgtgtttaaactcaatggaatctaatatttctttatgtcgttagtccctgtaaaatgttaggtcacccaaggaaaggggagaaatagcaatggttgttcctaaggtattgcttgccctccatgtcttcctaaagagcagaacttggagtttctcctttatgtagagaagaagtaacttagggtgtatttgcaatgaaatattcatagatattgaaagctt

SEQ ID NO: 4650 - DNA, 618 bp, Homo sapiens
ccgcaggaccccaaaacccaatgatcctgcagcagcccttgcagcgaggcccccagggaggggcccagcgcctcccgcgggccgccttgggggtgacttggggcctggacgccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaa

SEQ ID NO: 4651 - DNA, 1892 bp, Homo sapiens
ctcacgggagtcctccgcccgggcgtccggaacagtcgacggcagactccggcccgctgagccacccgaggggtcccgtggcctccgcggacccggaatctgggccctcgcggacccgcgccccgcccagtcgccccagcccgtccactgctctgttcgccagggcttccccacacccacggagtgaagtcagccgcggccctgcctgggaggaacttaccgtctaccgggaaaggtggccagcagatgtgtcgggcctggtgagaggggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttg

SEQ ID NO: 4652 - DNA, 1806 bp, Homo sapiens
cacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctgg

SEQ ID NO: 4653 - DNA, 1221 bp, Homo sapiens
gctcaggccccgccctcagacgagcaccgcccgccggctcctcccgcggctcgaatcgccgtctctctcctccccgccccgccgagttctagaattcgccgcgcagctgcttcagcccctcagccccagccggaccctcgggtcctcatccaccctcgcaggcgcaggccgtggctaccccgaagtcaactgtggaggatccttcctggcttccttcagctccatcctgcccttggatctagcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggagcaccccaagtcctgttttcctccaggccccgctcctggccttgtattctctctgctctgttattaaaaagcaagcaagtgga

SEQ ID NO: 4654 - DNA, 2579 bp, Homo sapiens; identical to SEQ ID NO: 4457

SEQ ID NO: 4655 - DNA, 1406 bp, Homo sapiens
gggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctca

SEQ ID NO: 4656 - DNA, 2763 bp, Homo sapiens
atactccggttgtgggcgggaccagacggtacctagggggatccgggcgcagccaatcctggccctaggattgtgttggggggcttggcaggcggtgtcccgacccccctttctgggcatcctggggatgaccccagcgccgggcccggcgccggccgcctgatgccaggcgagctgagctggggatgctggaacgaagggcgttgctatggcaacgggaggcagggcctggttggggggaccgggcccgggctgggaccgggggggccggcggtggctgtggtggggcgatggcggagcgcggcccggccttctgcggcctgtacgacacgtcctcgctgctgcgatactgcaacgatgacaatttgtcgggcacgagcggtatggaagtggacgaccgcgtgtcggcgctggagcagcggctgcagttacaggaagacgagctggcggtcctaaaggcggcgctggcggatgctctgcgtcgcctgcgggcatgcgaagaacagggagcggcgctacgcgcgcggggcacccccaagggccgggcgcctccgcgcttaggcaccactgcctcggtgtgtcagctcttgaaaggccttcccaccaggacgccccttaatggctcgggacccccgcggcgcgtgggtggctatgccacgtccccatcctctcccaagaaggaggcgacctccgggcgcagcagtgtccgccgctacttgtcaccagagcgcctcgcctcggtgcgccgtgaggacccccgcagccggaccacatcctccagcagcaactgtagcgccaaaaaggaaggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtc

SEQ ID NO: 4657 - DNA, 4217 bp, Homo sapiens
ccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatcttttttttttttgagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatccttgg

SEQ ID NO: 4658 - DNA, 9202 bp, Homo sapiens
gatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 4659 - DNA, 4751 bp, Homo sapiens
ggacgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccactt

SEQ ID NO: 4660 - DNA, 697 bp, Homo sapiens
ccgtgcgcccaagctcgaccgcctgaaatcggggaatcgggcctctgccggcgccctggcagcggcgcggggcgtggctccgggctggattggtggcgcctgggccccgcgagcgcctgcgcagtggtcaaggccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaa

SEQ ID NO: 4661 - DNA, 3406 bp, Homo sapiens
gaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggt

SEQ ID NO: 4662 - DNA, 2315 bp, Homo sapiens
caaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtctggagtgcaatggcacaatctcagctcacagcaacctctgcctcctgggttcaagcgattctcctgcctcagcctccaaagtagctgggattacaggcatgcgccaccacacccagctaattttttgtatttggtagagatggagtttcaccatggtggtcaggctggtcttgaactcctgacctcaggtgatccacccgcccgccttggcctcccaaagtgctaggattccaggcgtgagccatcgtgcccagctagacgtcttccttttttttttttttttgagacggagtctcactctgtcgcccaggctggagtgcagtggtgcgatctcagctcactgcaagctccgcctcctcccgggttcacgccattctcctgcctcagcctcctgagtagctgggactacaggcacctgccaccatgcgcagctaattttttgtatttttagtagagacggggtttcaccatgttagacaggatggtctccatctcctgagtttgtgatctgcccgccttggcctcccaaagtgctgggattacaggtgtgagtcaccgcgcctggccttttttttttttttttttactggatttctttttctcctgattttcggcctcagctcctagagtggcctcagctaggtaaccaacgggagtcgacttatctatgccaggcctgcagtttcacatctgtgacgggatgggacaaatgacaccgtggtattcgatgacagctcccaggtacttcaaggttggcccttactcattcagggggtatgtttgagtgccacggtgtgcccagactctgctaggcaccagagagacaagatacgagtgacatggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcctgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatgtactcc

SEQ ID NO: 4663 - DNA, 1005 bp, Homo sapiens
tttccggtgtcggggcacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaa

SEQ ID NO: 4664 - DNA, 1470 bp, Homo sapiens
tttccaagttctttctagcctcaaccagtttctgtctctgcttgttctgcagcccgctgaactacatttcccaggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaa

SEQ ID NO: 4665 - DNA, 3184 bp, Homo sapiens
tgttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaaacccagcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaaga

SEQ ID NO: 4666 - DNA, 4082 bp, Homo sapiens
aatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgaggtgagtcgagcggttttgaagccggactacctcaagtctctttcctcacttctttctcttcacttaaaacaatttttttggaggggttttggggaggaagtgagcggacgctggggatgggtctcgtaagcggccggattgagaggagggaggaagcagggggcttccgagtgggtgacccagacgcgggctgtggggtggggcagttcgtggggtccggtcctggaaaggcgtcgactgccccccaactcttctggtttcctctacgatgagcggaaggtttgaatcctggaggtggggtctccggtgtggagttctggaaactgtgaggtgatttgcagctggtggaatggaacagtgaagaagcattggaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaaacccagcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaagagccttcaatgtagcagcacagggtgcgcctgaaagaggcacaactgctgtggattttctgcctcgctccatctctcctatgtataatgaagccttgtttaaaggggcatgtggggctggatgttaagcacggcttctttttgtccgttacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcatttccttatctgttaatcctgcttatgtgagtgtgaggaaagtctttgagagggcatgaaagtgccaccttatatatgtctgtgactttaaagagctatatgcagggcctggtcccacttttgtccatggatttcagggggaaaaaatatatgtacttttttcagcttccaagcattgaa

SEQ ID NO: 4667 - DNA, 1257 bp, Homo sapiens
tgttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaaggaacacttggtcccctgagagaaggatggaagaaaataaatggaagttgctttctgcagggtag

SEQ ID NO: 4668 - DNA, 3244 bp, Homo sapiens
tgttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaaacccagcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaa

SEQ ID NO: 4669 - DNA, 811 bp, Homo sapiens
gttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagagtttcgctcttgtccatgctggagtgcaatggtgtaatctcagctcaccacaacctccgcctcctgggttcaagtgattctcctgcctcagcttcctgagtagctgggattacagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatggg

SEQ ID NO: 4670 - DNA, 1731 bp, Homo sapiens
aaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttcccc

SEQ ID NO: 4671 - DNA, 1765 bp, Homo sapiens
gttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggtagaagaagagaggaggatctgatccaaacaagcaagttacaccattcacgacacacactcagtgtttgagaaatactaggggcagctggaccccatgcctaaacacgtaccgacgcagggcacgatggaaggccccactcactctggccccactgcagtgggaaccctcctgcccaaaggagtggttcttccagagtctctggcacactgacacatgcatcctctcat

SEQ ID NO: 4672 - protein, 459 aa, Homo sapiens
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 4673 - protein, 158 aa, Homo sapiens
MEPPEGAGTGEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 4674 - protein, 317 aa, Homo sapiens
MASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKAAVVCVTLLDRLDCDQINLPHDVLVEYQQRPQLLISNFIRRRLGLCD

SEQ ID NO: 4675 - protein, 364 aa, Homo sapiens
MSEVEAAAGATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 4676 - protein, 1901 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESNGNSSSWSSLGLEGDLYEDNLSFPTSDSDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 4677 - protein, 138 aa, Homo sapiens
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 4678 - protein, 369 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALGVIRSLHSLGRLEHAFCTETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 4679 - protein, 1219 aa, Homo sapiens
MMSLSVRPQRRLLSARVNRSQSFAGVLGSHERGPRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 4680 - protein, 441 aa, Homo sapiens
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 4681 - protein, 205 aa, Homo sapiens
MAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSESTITISLYIPSEQQFDPPRPLESDVFIEDRAEMTVFVRSFDGFSSAQKNQEQLLTLASILREDGKVFDEKVYYTAGYNSPVKLLNRNNEVWLIQKNEPTKENE

SEQ ID NO: 4682 - protein, 207 aa, Homo sapiens
MSCTIEKILTDAKTLLERLREHDAAAESLVDQSAALHRRVAAMREAGTALPDQYQEDASDMKDMSKYKPHILLSQENTQIRDLQQENRELWISLEEHQDALELIMSKYRKQMLQLMVAKKAVDAEPVLKAHQSHSAEIESQIDRICEMGEVMRKAVQVDDDQFCKIQEKLAQLELENKELRELLSISSESLQARKENSMDTASQAIK

SEQ ID NO: 4683 - protein, 343 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 4684 - protein, 1015 aa, Homo sapiens
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERAATGVHIEPPWGAASAMAEQSEWLSVQAAR

SEQ ID NO: 4685 - protein, 298 aa, Homo sapiens
MAAAEPAVLALPNSGAGGAGAPSGTVPVLFCFSVFARPSSVPHGAGYELLIQKFLSLYGDQIDMHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFALERLARTGIIVTTSEAVLLQLVADKDHPKFKEIQNLIKASAPESGLLSKV

SEQ ID NO: 4686 - protein, 812 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQQNRMHPFRDDRRSKSIEEREEEYQRVRERIFAHDSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 4687 - protein, 396 aa, Homo sapiens
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 4688 - protein, 334 aa, Homo sapiens
MEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKRLKSSTSFANIQENSN

SEQ ID NO: 4689 - protein, 723 aa, Homo sapiens
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 4690 - protein, 1873 aa, Homo sapiens
MFSRRSHGDVKKSTQKVLDPKKDVLTRLKHLRALLDNVDANDLKQFFETNYSQIYFIFYENFIALENSLKLKGNNKSQREELDSILFLFEKILQFLPERIFFRWHYQSIGSTLKKLLHTGNSIKIRCEGIRLFLLWLQALQTNCAEEQVLIFACLVPGFPAVMSSRGPCTLETLINPSPSVADVKIYPEEITPLLPAISGEKIAEDQTCFFLQILLKYMVIQAASLEWKNKENQDTGFKFLFTLFRKYYLPHLFPSFTKLTNIYKPVLDIPHLRPKPVYITTTRDNENIYSTKIPYMAARVVFIKWIVTFFLEKKYLTATQNTKNGVDVLPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKQIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTD

SEQ ID NO: 4691 - protein, 582 aa, Homo sapiens
MGGSSPVTSKAIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITSTGDQALEVLQYLFSNDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYANGIRVMSMTHTGEPGFMLYIPIEGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSAFLALPPPPPNIHSGLFFPSHPSLSFSWWQEVCLTGQKQAP

SEQ ID NO: 4692 - protein, 706 aa, Homo sapiens
MNESKPGDSQNLACVFCRKHDDCPNKYGEKKTKEKWNLTVHYYCLLMSSGIWQRGKEEEGVYGFLIEDIRKEVNRASKLKCCVCKKNGASIGCVAPRCKRSYHFPCGLQRECIFQFTGNFASFCWDHRPVQIITSNNYRESLPCTICLEFIEPIPSYNILRSPCCKNAWFHRDCLQVQAINAGVFFFRCTICNNSDIFQKEMLRMGIHIPEKDASWELEENAYQELLQHYERCDVRRCRCKEGRDYNAPDSKWEIKRCQCCGSSGTHLACSSLRSWEQNWECLECRGIIYNSGEFQKAKKHVLPNSNNVGITDCLLEESSPKLPRQSPGSQSKDLLRQGSKFRRNVSTLLIELGFQIKKKTKRLYINKANIWNSALDAFRNRNFNPSYAIEVAYVIENDNFGSEHPGSKQEFLSLLMQHLENSSLFEGSLSKNLSLNSQALKENLYYEAGKMLAISLVHGGPSPGFFSKTLFNCLVYGPENTQPILDDVSDFDVAQIIIRINTATTVADLKSIINECYNYLELIGCLRLITTLSDKYMLVKDILGYHVIQRVHTPFESFKQGLKTLGVLEKIQAYPEAFCSILCHKPESLSAKILSELFTVHTLPDVKALGFWNSYLQAVEDGKSTTTMEDILIFATGCSSIPPAGFKPTPSIECLHVDFPVGNKCNNCLAIPITNTYKEFQENMDFTIRNTLRLEKEESSHYIGH

SEQ ID NO: 4693 - protein, 422 aa, Homo sapiens
MNSGHSFSQTPSASFHGAGGGWGRPRSFPRAPTVHGGAGGARISLSFTTRSCPPPGGSWGSGRSSPLLGGNGKATMQNLNDRLASYLEKVRALEEANMKLESRILKWHQQRDPGSKKDYSQYEENITHLQEQIVDGKMTNAQIILLIDNARMAVDDFNLKYENEHSFKKDLEIEVEGLRRTLDNLTIVTTDLEQEVEGMRKELILMKKHHEQEMEKHHVPSDFNVNVKVDTGPREDLIKVLEDMRQEYELIIKKKHRDLDTWYKEQSAAMSQEAASPATVQSRQGDIHELKRTFQALEIDLQTQYSTKSALENMLSETQSRYSCKLQDMQEIISHYEEELTQLRHELERQNNEYQVLLGIKTHLEKEITTYRRLLEGESEGTREESKSSMKVSATPKIKAITQETINGRLVLCQVNEIQKHA

SEQ ID NO: 4694 - protein, 191 aa, Homo sapiens
MGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKS

SEQ ID NO: 4695 - protein, 609 aa, Homo sapiens
MEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 4696 - protein, 350 aa, Homo sapiens
MFIKGRAPRAPPRERRRATRGGLRQVVAPPRALGSTSRPHFRRASVCRRRCRKSGGLLAASRKMAAAAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 4697 - protein, 126 aa, Homo sapiens
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGRGNIFQKRR

SEQ ID NO: 4698 - protein, 970 aa, Homo sapiens
MLCFLDDGAGMDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 4699 - protein, 863 aa, Homo sapiens
MAGPRGALLAWCRRQCEGYRGVEIRDLSSSFRDGLAFCAILHRHRPDLLDFDSLSKDNVFENNRLAFEVAEKELGIPALLDPNDMVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELASPPAGRPTPAPRKASESTTPAPPTPRPRSSLQQENLVEQAGSSSLVNGRLHELPVPKPRGTPKPSEGTPAPRKDPPWITLVQAEPKKKPAPLPPSSSPGPPSQDSRQVENGGTEEVAQPSPTASLESKPYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQVKSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKEFQREAEPEGKKKGKFKTMKMLKLLGNKRDAKSKSPRDKS

SEQ ID NO: 4700 - protein, 180 aa, Homo sapiens
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 4701 - protein, 126 aa, Homo sapiens
MPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 4702 - protein, 966 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLVSTHHLHSSSEDEDIEGAFPNELSLQQAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKASQASYFAVSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 4703 - protein, 108 aa, Homo sapiens [sequence omitted]

SEQ ID NO: 4704 - protein, 669 aa, Homo sapiens
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 4705 - protein, 576 aa, Homo sapiens
MRGPNSGTEKGRLVIPEKQGFDFLCMPVFHPRFKREFIQEPAKNRPGPQTRSDLLLSGRAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 4706 - protein, 188 aa, Homo sapiens
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 4707 - protein, 338 aa, Homo sapiens
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 4708 - protein, 985 aa, Homo sapiens
MIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTDLETIANLGLGFWDSSLNPPQERGKPAEPPRDRAPGFPLVSSLRPTAHDANCACEIELSVGNDRLWFVNPIFIEDCSSALPTDQPPLGNCPARPLPPTSDATSPTSRWAPRRPPPPPPVLPLQPCSPAQPPVLPALAPAPACPLPTSPPVPAPHVTPHAPGPPDHPNQPPMMTCERLPCPTAGLGPLREEAMKPGAASSPLQQVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQDFICVSYLEPEQQARTLASRADTQAQALCAQCAEKFAVERPQAHRLFVLVDGRCFQLADDALPHCIKGYLLRSEPKRDFHFVYRPLDGGGGGGGGSPPCLVVREPNFL

SEQ ID NO: 4709 - protein, 435 aa, Homo sapiens
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVEHINRKCLLNLVQDLDCKDNEILTYSLQSPLHV

SEQ ID NO: 4710 - protein, 451 aa, Homo sapiens
MVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDNLLHQQMLQSEIQAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 4711 - protein, 129 aa, Homo sapiens
  MOD_RES (1)..(1): Any amino acid
XSEVPLPPGALATLSSSCSLGVALHRSSPASRGPGESSLPAFSGVALLPPACKAGLPYNLSRQEGHLTCLSIPDIKTAFSDCTSKIGRRDCLTQACSALTGKGVREGIEWMVKCVVRNVHRPPRQRDIT

SEQ ID NO: 4712 - protein, 615 aa, Homo sapiens
MARACLIQRLPIKRDCTPVFVRGLSSPSAAMALLSEGLDEVPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 4713 - protein, 289 aa, Homo sapiens
MVGVKPVGSDPDFQPELSGAGSRLAVVKFTMRGCGPCLRIAPAFSSMSNKYPQAVFLEVDVHQCQGTAATNNISATPTFLFFRNKVRIDQYQGADAVGLEEKIKQHLENDPGSNEDTDIPKGYMDLMPFINKAGCECLNESDEHGFDNCLRKDTTFLESDCDEQLLITVAFNQPVKLYSMKFQGPDNGQGPKYVKIFINLPRSMDFEEAERSEPTQALELTEDDIKEDGIVPLRYVKFQNVNSVTIFVQSNQGEEETTRISYFTFIGTPVQATNMNDFKRVVGKKGESH

SEQ ID NO: 4714 - protein, 171 aa, Homo sapiens
MSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKKGNFNYIEFTRILKHGAKDKDD

SEQ ID NO: 4715 - protein, 226 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 4716 - protein, 742 aa, Homo sapiens
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPLETTLGGSMNSVSKLIHYVGWLSTTAMRLESNNTFLLHFILDFYEKVCDIYINYNLPLVVLFPPGIFYSALLSLDTSILNQLCFIMHRYRKNLTAAKKNELVQKTKSEFNFSSKTYQEFNHYLTSMVGCLWTSKPFGKGIYIDPEILEKTGVAEYKNSLNVVHHPSFLSYAVSFLLQGKKWSWYLDYLFSQGLQGLKLFIRSSVHHSSIPRAEGINCNNQY

SEQ ID NO: 4717 - protein, 127 aa, Homo sapiens
MGDKPIWEQIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKNINDAWVCTNDMFRLALHNFG

SEQ ID NO: 4718 - protein, 163 aa, Homo sapiens
MDALEGESFALSFSSASDAEFDAVVGYLEDIIMDDEFQLLQRNFMDKYYLEFEDTEENKLIYTPIFNEYISLVEKYIEEQLLQRIPEFNMAAFTTTLQHHKDEVAGDIFDMLLTFTDFLAFKEMFLDYRAEKEGRGLDLSSGLVVTSLCKSSSLPASQNNLRH

SEQ ID NO: 4719 - protein, 225 aa, Homo sapiens
MLGLDACELGAQLLELLRLALCARVLLADKEGGPPAVDEVLDEAVPEYRAPGRKSLLEIRQLDPDDRSLAKYKRVLLGPLPPAVDPSLPNVQVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 4720 - protein, 235 aa, Homo sapiens
MEEETHTDAKIRAENGTGSSPRGPGCSLRHFACEQNLLSRPDGSASFLQGDTSVLAGVYGPAEVKVSKEIFNKATLEVILRPKIGLPGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 4721 - protein, 402 aa, Homo sapiens
MPWKLWRGSVGCPGDLSSDGLLFRLGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 4722 - protein, 496 aa, Homo sapiens
MDDVPAPTPAPAPPAAAAPRVPFHCSECGKSFRYRSDLRRHFARHTALKPHACPRCGKGFKHSFNLANHLRSHTGERPYRCSACPKGFRDSTGLLHHQVVHTGEKPYCCLVCELRFSSRSSLGRHLKRQHRGVLPSPLQPGPGLPALSAPCSVCCNVGPCSVCGGSGAGGGEGPEGAGAGLGSWGLAEAAAAAAASLPPFACGACARRFDHGRELAAHWAAHTDVKPFKCPRCERDFNAPALLERHKLTHDLQGPGAPPAQAWAAGPGAGPETAGEGTAAEAGDAPLASDRRLLLGPAGGGVPKLGGLLPEGGGEAPAPAAAAEPSEDTLYQCDCGTFFASAAALASHLEAHSGPATYGCGHCGALYAALAALEEHRRVSHGEGGGEEAATAAREREPASGEPPSGSGRGKKIFGCSECEKLFRSPRDLERHVLVHTGEKPFPCLECGKFFRHECYLKRHRLLHGTERPFPCHICGKGFITLSNLSRHLKLHRGMD

SEQ ID NO: 4723 - protein, 657 aa, Homo sapiens
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVPSQLRAFTVPSVELSSAKPSQTSHLPTSLAADRTLHSTRSRADYPQSHVSSDTASHTPSVSITGAFSNSVSLKMGHVKLVSSPGRSEAETVDEPVSEGADDSLDEFRINILSLDGLAPAVSENSDLEQEEESAQRQKTAGKIFRAEASTGQDAPRQAQARSWASQGKAASAEGDESEVSEHLSASSASAIQQDSTSSMQPPSEAPMVNTVSSAYSEDFENSPSLTASEPTAHSKESLDRTLDALSESSSSVKTDLPQTAESRKKSGRHVTRVLVKDTAVQTPDPAFTYEWTKVASMAAMGPALGGAYVDPTPIANHVISADAIEALTAYSPAVLALHDVLKQQLSLTQQFIQASRHLHASLLRSLDADSFHYHTLEEAKEYIRCHRPAPLTMEDALEEVNKEL

SEQ ID NO: 4724 - protein, 125 aa, Homo sapiens
MADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 4725 - protein, 244 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 4726 - protein, 378 aa, Homo sapiens
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 4727 - protein, 483 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 4728 - protein, 320 aa, Homo sapiens
MPMYQVKPYHGGGAPLRVELPTCMYRLPNVHGRSYGPAPGAGHVQEESNLSLQALESRQDDILKRLYELKAAVDGLSKMIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 4729 - protein, 148 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 4730 - protein, 518 aa, Homo sapiens
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 4731 - protein, 300 aa, Homo sapiens
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 4732 - protein, 478 aa, Homo sapiens
MAARPITLGIDLGTTSVKAALLRAAPDDPSGFAVLASCARAARAEAAVESAVAGPQGREQDVSRILQALHECLAALPRPQLRSVVGIGVSGQMHGVVFWKTGQGCEWTEGGITPVFEPRAVSHLVTWQDGRCSSEFLASLPQPKSHLSVATGFGCATIFWLLKYRPEFLKSYDAAGTIHDYVVAMLCGLPRPLMSDQNAASWGYFNTQSQSWNVETLRSSGFPVHLLPDIAEPGSVAGRTSHMWFEIPKGTQVGVALGDLQASVYSCMAQRTDAVLNISTSVQLAASMPSGFQPAQTPDPTAPVAYFPYFNRTYLGVAASLNGGNVLATFVHMLVQWMADLGLEVEESTVYSRMIQAAVQQRDTHLTITPTVLGERHLPDQLASVTRISSSDLSLGHVTRALCRGIVQNLHSMLPIQQLQDWGVERVMGSGSALSRNDVLKQEVQRAFPLPMSFGQDVDAAVGAALVMLRRHLNQKES

SEQ ID NO: 4733 - protein, 124 aa, Homo sapiens
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 4734 - protein, 185 aa, Homo sapiens
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 4735 - protein, 366 aa, Homo sapiens
MAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 4736 - protein, 186 aa, Homo sapiens [sequence omitted]

SEQ ID NO: 4737 - protein, 519 aa, Homo sapiens
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKVILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNA

SEQ ID NO: 4738 - protein, 842 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVRNLTYMVTRREKIKRSVCKVQEQIFNLYTKLLEQERVSGVPSSCSSSSLENMLLFNSPSVGPDAPKIEDLKWHSAFFRKQMGTSLVHSLKKPHKRDPLQNSPGSEGKTLLKQPDLCGRREGMVVPESFLGLEKTFAEARLISAQQKNGVVMPDHGKRRDNRFHCDLIKGDLKDKSFKQSHKPLRSTDVSQRHLDNTRAATSPGVGQSAPGTRKEIVPKCNGSLIKVNYNQTAVKVPTTPASPVKNWGGFRIPKKGERQQQGEAHDGACHQHSDYPYLGLGRVPAKERAKSKLKSDNENDGYVPDVEMSDSESEASEKKCIHTSSTISRRTDIIRRSILAS

SEQ ID NO: 4739 - protein, 294 aa, Homo sapiens
MNSELDYYEKFEEVHGILMYKDFVKYWDNVEAFQARPDDLVIATYPKSGTTWVSEIVYMIYKEGDVEKCKEDVIFNRIPFLECRKENLMNGVKQLDEMNSPRIVKTHLPPELLPASFWEKDCKIIYLCRNAKDVAVSFYYFFLMVAGHPNPGSFPEFVEKFMQGQVPYGSWYKHVKSWWEKGKSPRVLFLFYEDLKEDIRKEVIKLIHFLERKPSEELVDRIIHHTSFQEMKNNPSTNYTTLPDEIMNQKLSPFMRKGITGDWKNHFTVALNEKFDKHYEQQMKESTLKFRTEI

SEQ ID NO: 4740 - protein, 151 aa, Homo sapiens
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 4741 - protein, 459 aa, Homo sapiens
MAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 4742 - protein, 619 aa, Homo sapiens
MLLASAVVVWEWLNEHGRWRPYSPAVSHHIEAVVRAGPRAGGSVVLGQVDSRLAPYIIDLQSMNQFRQDTGTLRPVRRNYYDPSSAPGKGVVWEWENDNGSWTPYDMEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 4743 - protein, 178 aa, Homo sapiens [sequence omitted]

SEQ ID NO: 4744 - protein, 853 aa, Homo sapiens
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPERLHFEMTHKEIPCQGPRAQLGNGSSVDEVSFYANRLTNLVIAMARKEINEKIDGSENKCVYQSLYMGNEPTPTKSLSKIASELVNETVSACSRNAAPDKAPGSGDRVSGSSQSPPNLKYKSTLKIKESTKERQGPDDKPPSKKSFFYKEVFESRNGDYAREGGRFFPRERKRFRGQERPDDFTASVSEGIMTYANSVVSDMMVSIMKTLKIQVKDTTIATILLKKVLLKHAKEVVSDLIDSFLRNLHSVTGTLMTDTQFVSAVKRTVFSHGSQKATDIMDAMLRKLYNVMFAKKVPEHVRKAQDKAESYSLISMKGMGDPKNRNVNFAMKSETKLREKMYSEPKSEEETCAKTLGEHIIKEGLTLWHKTQQKECKSLGFQHAAFEAPNTQRKPASDISFEYPEDIGNLSLPPYPPEKPENFMYDSDSWAEDLIVSALLLIQYHLAQGGRRDARSFVEAAGTTNFPANEPPVAPDESCLKSAPIVGDQEQAEKKDLRSVFFNFIRNLLSETIFKRDQSPEPKVPEQPVKEDRKLCERPLASSPPRLYEDDETPGALSGLTKMAVSQIDGHMSGQMVEHLMNSVMKLCVIIAKSCDASLAELGDDKSGDASRLTSAFPDSLYECLPAKGTGSAEAVLQNAYQAIHNEMRGTSGQPPEGCAAPTVIVSNHNLTDTVQNKQLQAVLQWVAASELNVPILYFAGDDEGIQEKLLQLSAAAVDKGCSVGEVLQSVLRYEKERQLNEAVGNVTPLQLLDWLMVNL

SEQ ID NO: 4745 - protein, 665 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 4746 - protein, 275 aa, Homo sapiens
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLQEWCVGCEVVLSGIEEQVSRANQHKEQQLGLKQQIESEVANLKKTIKVTTAAAAAATSQDPEQHLTELREPAPGTNQRQPSKKASKGKGLRGSAKIWSKSN

SEQ ID NO: 4747 - protein, 253 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKIDMVHRNKSEGFFLDASRHILEAPQHGLERRHLEANQNELQAHVDQITEMAAVMRKAIEIDEQQGCKEQERIFQLEQENKGLREILQITRESFLNLRKDDASESTSLSALVTNSDLSLRKS

SEQ ID NO: 4748 - protein, 140 aa, Homo sapiens
MTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 4749 - protein, 209 aa, Homo sapiens
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEETVEDSLVEDSEIGTCAEGTVSSSTDAKPCI

SEQ ID NO: 4750 - protein, 174 aa, Homo sapiens
MAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRVLSAMIRGAADGSRFQVWDYEEGEVEALLDRYFEADPPGQVAASPDPTT

SEQ ID NO: 4751 - protein, 462 aa, Homo sapiens
MSSVKRSLKQEIVTQFHCSAAEGDIAKLTGILSHSPSLLNETSENGWTALMYAARNGHPEIVQFLLEKGCDRSIVNKSRQTALDIAVFWGYKHIANLLATAKGGKKPWFLTNEVEECENYFSKTLLDRKSEKRNNSDWLLAKESHPATVFILFSDLNPLVTLGGNKESFQQPEVRLCQLNYTDIKDYLAQPEKITLIFLGVELEIKDKLLNYAGEVPREEEDGLVAWFALGIDPIAAEEFKQRHENCYFLHPPMPALLQLKEKEAGVVAQARSVLAWHSRYKFCPTCGNATKIEEGGYKRLCLKEDCPSLNGVHNTSYPRVDPVVIMQVIHPDGTKCLLGRQKRFPPGMFTCLAGFIEPGETIEDAVRREVEEESGVKVGHVQYVACQPWPMPSSLMIGCLALAVSTEIKVDKNEIEDARWFTREQVLDVLTKGKQQAFFVPPSRAIAHQLIKHWIRINPNL

SEQ ID NO: 4752 - protein, 215 aa, Homo sapiens
MNLVGSYAHHHHHHHPHPAHPMLHEPFLFGPASRCHQERPYFQSWLLSPADAAPDFPAGGPPPAAAAAATAYGPDARPGQSPGRLEALGGRLGRRKGSGPKKERRRTESINSAFAELRECIPNVPADTKLSKIKTLRLATSYIAYLMDVLAKDAQSGDPEAFKAELKKADGGRESKRKRELQQHEGFPPALGPVEKRIKGRTGWPQQVWALELNQ

SEQ ID NO: 4753 - protein, 298 aa, Homo sapiens
MWGACKVKVHDSLATISITLRRYLRLGATMAKSKFEYVRDFEADDTCLAHCWVVVRLDGRNFHRFAEKHNFAKPNDSRALQLMTKCAQTVMEELEDIVIAYGQSDEYSFVFKRKTNWFKRRASKFMTHVASQFASSYVFYWRDYFEDQPLLYPPGFDGRVVVYPSNQTLKDYLSWRQADCHINNLYNTVFWALIQQSGLTPVQAQGRLQGTLAADKNEILFSEFNINYNNELPMYRKGTVLIWQKVDEVMTKEIKLPTEMEGKKMAVTRTRTKPVPLHCDIIGDAFWKEHPEILDEDS

SEQ ID NO: 4754 - protein, 574 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSGMGLYEGLDWLSRQLVAAGVLDVA

SEQ ID NO: 4755 - protein, 440 aa, Homo sapiens
MGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDSLSLSTLSRMLSTHNLPCLLVELLEHSPWSRREGGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 4756 - protein, 338 aa, Homo sapiens
MELWGRMLWALLSGPGRRGSTRGWAFSSWQPQPPLAGLSSAIELVSHWTGVFEKRGIPEARESSEYIVAHVLGAKTFQSLRPALWTQPLTSQQLQCIRELSSRRLQRMPVQYILGEWDFQGLSLRMVPPVFIPRPETEELVEWVLEEVAQRSHAVGSPGSPLILEVGCGSGAISLSLLSQLPQSRVIAVDKREAAISLTHENAQRLRLQDRIWIIHLDMTSERSWTHLPWGPMDLIVSNPPYVFHQDMEQLAPEIRSYEDPAALDGGEEGMDIITHILALAPRLLKDSGSIFLEVDPRHPELVSSWLQSRPDLYLNLVAVRRDFCGRPRFLHIRRSGP

SEQ ID NO: 4757 - protein, 410 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 4758 - protein, 407 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 4759 - protein, 44 aa, Homo sapiens
MADKPDMGEIASFDKAKLKKTETQEKNTLPTKETIEQEKRSEIS

SEQ ID NO: 4760 - protein, 535 aa, Homo sapiens
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 4761 - protein, 193 aa, Homo sapiens
MDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 4762 - protein, 890 aa, Homo sapiens
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKHRKTGRDVAIKVIDKMRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 4763 - protein, 368 aa, Homo sapiens
MEPGQPREPQEPREPGPGAETAAAPVWEEAKIFYDNLAPKKKPKSPKPQNAVTIAVSSRALFRMDEEQQIYTEQGVEEYVRYQLEHENEPFSPGPAFPFVKALEAVNRRLRELYPDSEDVFDIVLMTNNHAQVGVRLINSINHYDLFIERFCMTGGNSPICYLKAYHTNLYLSADAEKVREAIDEGIAAATIFSPSRDVVVSQSQLRVAFDGDAVLFSDESERIVKAHGLDRFFEHEKAHENKPLAQGPLKGFLEALGRLQKKFYSKGLRLECPIRTYLVTARSAASSGARALKTLRSWGLETDEALFLAGAPKGPLLEKIRPHIFFDDQMFHVAGAQEMGTVAAHVPYGVAQTPRRTAPAKQAPSAQ

SEQ ID NO: 4764 - protein, 359 aa, Homo sapiens
MLSAASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 4765 - protein, 186 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGPNVKAVATAVEQIYPFVFESRKEIL

SEQ ID NO: 4766 - protein, 178 aa, Homo sapiens
MAAPLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLEQASANIPAPLKPT

SEQ ID NO: 4767 - protein, 245 aa, Homo sapiens
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 4768 - protein, 177 aa, Homo sapiens
MPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLELPYFVID

SEQ ID NO: 4769 - protein, 1219 aa, Homo sapiens
MFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQPYAGMQAYAYPQASAVTSQLQPVRPLYPAPLSQPPHFQGSGDMASFLMTEARQHNTEIRMAVSKVADKMDHLMTKVEELQKHSAGNSMLIPSMSVTMETSMIMSNIQRIIQENERLKQEILEKSNRIEEQNDKISELIERNQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKCLALQAQITALTKQNEQHIKELEKNKSQMSGVEAAASDPSEKVKKIMNQVFQSLRREFELEESYNGRTILGTIMNTIKMVTLQLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 4770 - protein, 2325 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKKISAAQTRLSELHDEIEKAEQQILRATEEFKQLEEAIQLKKISEAGKDLLYKQLSGRLQLVNKLRQEALDLELQMEKQKQEIAGKQKEIKDLQIAIDSLDSKDPKHSHMKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 4771 - protein, 936 aa, Homo sapiens
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDASGGSTLLNLDFFGPVDDSSSSSSTTIPGVDPELYELTTSKLEISTSSLKVTDAFARLMSTVEKTSTSTRKPKREEHLSEEAIKVIAGLPDLTFMHAKVLMFPATLTPSTSSQEKADG

SEQ ID NO: 4772 - protein, 909 aa, Homo sapiens
MEPDIIRMYSSSPPPLDNGAEDDDDDEFGEFGGFSEVSPSGVGFVDFDTPDYTRPKEEFVPSNHFMPIHEFSENVDSLTSFKSIKNGNDKDITAELSAPVKGQSDVLLSTTSKEIISSEMLATSIDGMERPGNLNKVVEQRQNVGTLESFSPGDFRTNMNVVHQNKQLESCNGEKPPCLEILTNGFAVLETVNPQGTDDLDNVADSKGRKPLSTHSTEYNLDSVPSPAEEFADFATFSKKERIQLEEIECAVLNDREALTIRENNKINRVNELNSVKEVALGRSLDNKGDTDGEDQVCVSEISIVTNRGFSVEKQGLPTLQQDEFLQSGVQSKAWSLVDSADNSEAIRREQCKTEEKLDLLTSKCAHLCMDSVKTSDDEVGSPKEESRKFTNFQSPNIDPTEENDLDDSLSVKNGDSSNDFVTCNDINEDDFGDFGDFGSASGSTPPFVTGTQDSMSDATFEESSEHFPHFSEPGDDFGEFGDINAVSCQEETILTKSDLKQTSDNLSEECQLARKSSGTGTEPVAKLKNGQEGEIGHFDSVPNIQDDCNGFQDSDDFADFSSAGPSQVVDWNAFEDEQKDSCSWAAFGDQQATESHHRKEAWQSHRTDENIDTPGTPKTHSVPSATSKGAVASGHLQESATSVQTALLNRLERIFEACFPSILVPDAEEEVTSLKHLLETSTLPIKTREALPESGELLDVWTELQDIHDAHGLRYQWGGSHSNKKLLSSLGIDTRNILFTGNKKQPVIVPMYAAGLGMLEPTKEPLKPLSAAEKIASIGQTATMSPDMNTCTSDQFQESLPPVQFDWSSSGLTNPLDGVDPELYELTTSKLEISTSSLKVTDAFARLMSTVEKTSTSTSRKPKREEHLSEEAIKVIAGLPDLTFMHAKVLMFPATLTPSTSSQEKADG

SEQ ID NO: 4773 - protein, 101 aa, Homo sapiens
MVCEKCEKKLGTVITPDTWKDGARNTTESGGRKLNENKALTSKKARFDPYGKNKFSTCRICKSSVHQPGSHYCQGCAYKKGICAMCGKKVLDTKNYKQTSV

SEQ ID NO: 4774 - protein, 488 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 4775 - protein, 85 aa, Homo sapiens
MSKVSFKITLTSDPRLPYKVLSVPESTPFTAVLKFAAEEFKVPAATSAIITNDGIGINPAQTAGNVFLKHGSELRIIPRDRVGSC

SEQ ID NO: 4776 - protein, 194 aa, Homo sapiens
MDEDGLPLMGSGIDLTKVPAIQQKRTVAFLNQFVVHTVQFLNRFSTVCEEKLADLSLRIQQIETTLNILDAKLSSIPGLDDVTVEVSPLNVTSVTNGAHPEATSEQPQQNSTQDSGLQESEVSAENILTVAKDPRYARYLKMVQVGVPVMAIRNKMISEGLDPDLLERPDAPVPDGESEKTVEESSDSESSFSD

SEQ ID NO: 4777 - protein, 741 aa, Homo sapiens
MGPPGPALPATMNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 4778 - protein, 169 aa, Homo sapiens
MKGSRIELGDVTPHNIKQLKRLNQVIFPVSYNDKFYKDVLEVGELAKLAYFNDIAVGAVCCRVDHSQNQKRLYIMTLGCLAPYRRLGIGTKMLNHVLNICEKDGTFDNIYLHVQISNESAIDFYRKFGFEIIETKKNYYKRIEPADAHVLQKNLKVPSGQNADVQKTDN

SEQ ID NO: 4779 - protein, 414 aa, Homo sapiens
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 4780 - protein, 676 aa, Homo sapiens
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDEFKRYVNKLRSKSTVFKKKHQIIAELKAEFGLLQRTEELLKQRHENIQQQLQTMEEKKGISGYSYTQEELERVSALKSEVDEMKGRTLDDMSEMVKKLYSLVSEKKSALASVIKELRQLRQKYQELTQECDEKKSQYDSCAAGLESNRSKLEQEVRRLREECLQEESRYHYTNCMIKNLEVQLRRATDEMKAYISSDQQEKRKAIREQYTKNTAEQENLGKKLREKQKVIRESHGPNMKQAKMWRDLEQLMECKKQCFLKQQSQTSIGQVIQEGGEDRLIL

SEQ ID NO: 4781 - protein, 315 aa, Homo sapiens
MAFPEPKPRPPELPQKRLKTLDCGQGAVRAVRFNVDGNYCLTCGSDKTLKLWNPLRGTLLRTYSGHGYEVLDAAGSFDNSSLCSGGGDKAVVLWDVASGQVVRKFRGHAGKVNTVQFNEEATVILSGSIDSSIRCWDCRSRRPEPVQTLDEARDGVSSVKVSDHEILAGSVDGRVRRYDLRMGQLFSDYVGSPITCTCFSRDGQCTLVSSLDSTLRLLDKDTGELLGEYKGHKNQEYKLDCCLSERDTHVVSCSEDGKVFFWDLVEGALALALPVGSGVVQSLAYHPTEPCLLTAMGGSVQCWREEAYEAEDGAG

SEQ ID NO: 4782 - protein, 600 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQENCGMSVCNGKIYILGGRRENGEATDTILCYDPATSIITGVAAMPRPVSYHGCVTIHRYNEKCFKL

SEQ ID NO: 4783 - protein, 269 aa, Homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 4784 - protein, 346 aa, Homo sapiens
MCEGPSRISGPIPPDPTLCPDNYRRPTSAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRSPKYDKVESRVKAQLQEPGPASGTESAHFLRAHSRCGPGLPPPHVSSPQPTPPGPEAKEPGLGVDFIRHNARAAKRAPRRHSCSLQVLAQVLEQQRQAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 4785 - protein, 607 aa, Homo sapiens
MAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAEDYVEELHKWRCPDYYENNVHKMQLPFSSKLLGSTLTSEEKQERRQQQLRRLQELNARRREEKLQLDQERLDRLLYVQELLEDGQMDQFHKALIELNMDSPEELQSYIQKLSIAVEQAKQKILQAEVNLEVDVVDSKPETPDLEQLEPSLEDVESMNDFDPLFSEETPGVEKPVTTVQPVFNLAAYHQLFVGTERIRAPEIIFQPSLIGEEQAGIAETLQYILDRYPKDIQEMLVQNVFLTGGNTMYPGMKARMEKELLEMRPFRSSFQVQLASNPVLDAWYGARDWALNHLDDNEVWITRKEYEEKGGEYLKEHCASNIYVPIRLPKQASRSSDAQASSKGSAAGGGGAGEQA

SEQ ID NO: 4786 - protein, 460 aa, Homo sapiens
MASREEVLALQAEVAQREEELNSLKQKLASALLAEQEPQPERLVPVSPLPPKAALSRDEILRYSRQLVLPELGVHGQLRLGTACVLIVGCGGLGCPLAQYLAAAGVGRLGLVDYDVVEMSNLARQVLHGEALAGQAKAFSAAASLRRLNSAVECVPYTQALTPATALDLVRRYDVVADCSDNVPTRYLVNDACVLAGRPLVSASALRFEGQITVYHYDGGPCYRCIFPQPPPAETVTNCADGGVLGVVTGVLGCLQALEVLKIAAGLGPSYSGSLLLFDALRGHFRSIRLRSRRLDCAACGERPTVTDLLDYEAFCGSSATDKCRSLQLLSPEERVSVTDYKRLLDSGAFHLLLDVRPQVEVDICRLPHALHIPLKHLERRDAESLKLLKEAIWEEKQGTQEGAAVPIYVICKLGNDSQKAVKILQSLSAAQELDPLTVRDVVGGLMAWAAKIDGTFPQY

SEQ ID NO: 4787 - protein, 346 aa, Homo sapiens
MESVSCSAAAVRTGDMESQRDLSLVPERLQRREQERQLEVERRKQKRQNQEVEKENSHFFVATFVRERAAVEELLERAESVERLEEAASRLQGLQKLINDSVFFLAAYDLRQGQEALARLQAALAERRRGLQPKKRFAFKTRGKDAASSTKVDAAPGIPPAVESIQDSPLPKKAEGDLGPSWVCGFSNLESQVLEKRASELHQRDVLLTELSNCTVRLYGNPNTLRLTKAHSCKLLCGPVSTSVFLEDCSDCVLAVACQQLRIHSTKDTRIFLQVTSRAIVEDCSGIQFAPYTWSYPEIDKDFESSGLDRSKNNWNDVDDFNWLARDMASPNWSILPEEERNIQWD

SEQ ID NO: 4788 - protein, 248 aa, Homo sapiens
MTPKGPAMCSMPLTSADCFSNDIHKLDTSTMTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 4789 - protein, 466 aa, Homo sapiens
MEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRDIYLHNPNIKWNDIIGLDAAKQLVKEAVVYPIRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 4790 - protein, 2133 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 4791 - protein, 570 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 4792 - protein, 596 aa, Homo sapiens
MNRTWPRRIWGSSQDEAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 4793 - protein, 649 aa, Homo sapiens
MSSFGAGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 4794 - protein, 263 aa, Homo sapiens
MAGLEVLFASAAPAITCRQDALVCFLHWEVVTHGYFGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPRPDRRGQ

SEQ ID NO: 4795 - protein, 90 aa, Homo sapiens
MDNMSPRLRAFLSEPIGEKDVCWVDGISHELAINLVTKGINKAYILLGQFLLMHKNEAEFQRWLICCFGATECEAQQTSHCLKEWCACFL

SEQ ID NO: 4796 - protein, 295 aa, Homo sapiens
MPVHTLSPGAPSAPALPCRLRTRVPGYLLRGPADGGARKPSAVERLEADKAKYVKSLHVANTRQEPVQPLLSKQPLFSPETRRTVLTPSRRALPGPCRRPQLDLDILSSLIDLCDSPVSPAEASRTPGRAEGAGRPPPATPPRPPPSTSAVRRVDVRPLPASPARPCPSPGPAAASSPARPPGLQRSKSDLSERFSRAAADLERFFNFCGLDPEEARGLGVAHLARASSDIVSLAGPSAGPGSSEGGCSRRSSVTVEERARERVPYGVSVVERNARVIKWLYGLRQARESPAAEG

SEQ ID NO: 4797 - protein, 193 aa, Homo sapiens
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 4798 - protein, 358 aa, Homo sapiens
MAAVLKPVLLGLRDAPVHGSPTGPGAWTASKLGGIPDALPTVAAPRPVCQRCGQPLALVVQVYCPLEGSPFHRLLHVFACACPGCSTGGARSWKVFRSQCLQVPEREAQDAQKQGNSLAAEDWCEGADDWGSDTEEGPSPQFTLDFGNDASSAKDVDWTARLQDLRLQDAVLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 4799 - protein, 592 aa, Homo sapiens
MASVVVKTIWQSKEIHEAGDTPTGVESCSQLVPEAPRRVTSRAKGIPKKKKAVSFHGVEPQMSHQPMHWCLNLKRSSACTNVSLLNLAAMEPTDSTGTDSTVEDLSGQLTLAGPPASPTLPWDPDDADITEILSGVNSGLVRAKDSITSLKEKTNRVNQHVQSLQSECSVLSENLERRRQEAEELEGYCIQLKENCWKVTRSVEDAEIKTNVLKQNSALLEEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPEEKMATLDHLHLKMCSLHDHLSNLPLEGSTGTMGGGSSAGTPPKQGGSAPEQ

SEQ ID NO: 4800 - protein, 846 aa, Homo sapiens
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 4801 - protein, 375 aa, Homo sapiens
MASAPWPERVPRLLAPRLPSYPPPPPTVGLRSMEQEETYLELYLDQCAAQDGLAPPRSPLFSPVVPYDMYILNASNPDTAFNSNPEVKETSGDFSSVDLSFLPDEVTQENKDQPVISKHETEENSESQSPQSRLPSPSEQDVGLGLNSSSLSNSHSQLHPGDTDSVQPSPEKPNSDSLSLASITPMTPMTPISECCGIVPQLQNIVSTVNLACKLDLKKIALHAKNAEYNPKRFAAVIMRIREPRTTALIFSSGKMVCTGAKSEEQSRLAARKYARVVQKLGFPARFLDFKIQNMVGSCDVRFPIRLEGLVLTHQQFSSYEPELFPGLIYRMVKPRIVLLIFVSGKVVLTGAKERSEIYEAFENIYPILKGFKKA

SEQ ID NO: 4802 - protein, 210 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 4803 - protein, 193 aa, Homo sapiens
MVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRDWYKRNFAITFFMGKVALERIWNKLKQKQKKRSN

SEQ ID NO: 4804 - protein, 460 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 4805 - protein, 326 aa, Homo sapiens
MATLVELPDSVLLEIFSYLPVRDRIRISRVCHRWKRLVDDRWLWRHVDLTLYTMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALESLCLQGPLVTPEMPSPTEILSSCLTMPKLRVLELQGLGWEGQEAEKILCKGLPHCMVIVRACPKESMDWWM

SEQ ID NO: 4806 - protein, 1029 aa, Homo sapiens
MASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDVEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 4807 - protein, 138 aa, Homo sapiens
MILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 4808 - protein, 190 aa, Homo sapiens
MFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 4809 - protein, 229 aa, Homo sapiens
MTCCSQVPPRRRPSLALSPRLDCNGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 4810 - protein, 1819 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQWEDEGFQSASNLTPDSQSEPSVTPDVDLWEAALTYEASKRRCWERVGCPPGHREEPYLTEAGRDAFDKFCRLHQGELQLLAGGVLQAPQPVLVKECELVKDVLNVLIGVVSATFSLCQPAQAFVVKRGVHVSGASPESISSLLSEVAEYGTCYTRLSHFSLQPVLDSLYSKGLVFQAFTSGLRRYLQYYRACVLSTPPTLSLLTIGFLFKKLGRQLRYLAELCGVGAVLPGTCGGGPRAAFPTGVKLLSYLYQEALHNCSNEHYPVLLSLLKTSCEPYTRFIHDWVYSGVFRDAYGEFMIQVNHEYLSFRDKLYWTHGYVLISKEVEDCVPVFLKHIAHDIYVCGKTINLLKLCCPRHYLCWSDVPVPRISVIFSLEELKEIEKDCAVYVGRMERVARHSSVSKEEKELRMEIAKQELIAHAREAASRVLSALSDRQMSERMALDARKREQFQRLKEQFVKDQERRQAARQEELDDDFSYARELRDRERRLKSLEEELERKARQALVDHYSKLSAEAARREQKALWRIQRHRLESARLRFLLEDEKHIQEMLKAVSEAHQPQEPPDVLLSVHPQVTSPGPEHPEGGQGCDSGSAEQHSPAWDGWNRPGLLTPQPLKPLAVGAGGRGLQQAEGARPFSDSLSIGDFLPVGPGAEPSVQTGMVPLLEVALQTINLDLPPSAPGEAPAAASTQPSRPQEYDFSTVLRPAVATSPAPGPLQAAECSLGSSGLQLWEDSCGKMDACGSASRETLLPSHPPRRAALEEGSSQPTERLFGQVSGGGLPTGDYASEIAPTRPRWNTHGHVSDASIRVGENVSDVAPTQPRWNTHGHVSNASISLGESVSDVAPTRPRWNIHGHVSNASIRVGENVSDVAPTRPRWNTHGHVSNASIRVGENVSDVAPTRPRWNTHGHVSDASISLGESVSDMAPARPRWNTHGHVSDASISLGESVSDMAPTRPRWNTHGHVSDTSIRVGENVSDVAPIRSRCNTHGHVSDASISLGEPVSDVVSTRPRWNTHVPIPPPHMVLGALSPEAEPNTPRPQQSPPGHTSQSALSLGAQSTVLDCGPRLPVEVGPSLSSPSSGCGEGSISVGENVSDVAPTQPWWPNTPGDSVSEELGPGRSGDTEDLSPNWPLNSQEDTAAQSSPGRGEEAEASAAEAQGGEQAYLAGLAGQYHLERYPDSYESMSEPPIAHLLRPVLPRAFAFPVDPQVQSAADETAVQLSELLTLPVLMKRSITAPLAAHISLVNKAAVDYFFVELHLEAHYEALRHFLLMEDGEFAQSLSDLLFEKLGAGQTPGELLNPLVLNSVLSKALQCSLHGDTPHASNLSLALKYLPEVFAPNAPDVLSCLELRYKVDWPLNIVITEGCVSKYSGVFSFLLQLKLMMWALKDVCFHLKRTALLSHMAGSVQFRQLQLFKHEMQHFVKVIQGYIANQILHVTWCEFRARLATVGDLEEIQRAHAEYLHKAVFRGLLTEKAAPVMNVIHSIFSLVLKFRSQLISQAWGPPGGPRGAEHPNFALMQQSYNTFKYYSHFLFKVVTKLVNRGYQPHLEDFLLRINFNNYYQDA

SEQ ID NO: 4811 - protein, 749 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVVRRRTQRRKSTITALLFGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 4812 - protein, 698 aa, Homo sapiens
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 4813 - protein, 59 aa, Homo sapiens
MTRGNQRELARQKNMKKQSDSVKGKRRDDGLSAAARKQRDSEIMQQKQKKANEKKEEPK

SEQ ID NO: 4814 - protein, 123 aa, Homo sapiens
MARYEEVSVSGFEEFHRAVEQHNGKTIFAYFTGSKDAGGKSWCPDCVQAEPVVREGLKHISEGCVFIYCQVGEKPYWKDPNNDFRKNLKVTAVPTLLKYGTPQKLVESECLQANLVEMLFSED

SEQ ID NO: 4815 - protein, 466 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 4816 - protein, 349 aa, Homo sapiens
MEDPQSKEPAGEAVALALLESPRPEGGEEPPRPSPEETQQCKFDGQETKGSKFITSSASDFSDPVYKEIAITNGCINRMSKEELRAKLSEFKLETRGVKDVLKKRLKNYYKKQKLMLKESNFADSYYDYICIIDFEATCEEGNPPEFVHEIIEFPVVLLNTHTLEIEDTFQQYVRPEINTQLSDFCISLTGITQDQVDRADTFPQVLKKVIDWMKLKELGTKYKYSLLTDGSWDMSKFLNIQCQLSRLKYPPFAKKWINIRKSYGNFYKVPRSQTKLTIMLEKLGMDYDGRPHCGLDDSKNIARIAVRMLQDGCELRINEKMHAGQLMSVSSSLPIEGTPPPQMPHFRK

SEQ ID NO: 4817 - protein, 280 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 4818 - protein, 302 aa, Homo sapiens
MVTEQEVDAIGQTLVDPKQPLQARFRALFTLRGLGGPGAIAWISQAFDDDSALLKHELAYCLGQMQDARAIPMLVDVLQDTRQEPMVRHEAGEALGAIGDPEVLEILKQYSSDPVIEVAETCQLAVRRLEWLQQHGGEPAAGPYLSVDPAPPAEERDVGRLREALLDESRPLFERYRAMFALRNAGGEEAALALAEGLHCGSALFRHEVGYVLGQLQHEAAVPQLAAALARCTENPMVRHECAEALGAIARPACLAALQAHADDPERVVRESCEVALDMYEHETGRAFQYADGLEQLRGAPS

SEQ ID NO: 4819 - protein, 1127 aa, Homo sapiens
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETAANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 4820 - protein, 815 aa, Homo sapiens
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKFVYL

SEQ ID NO: 4821 - protein, 212 aa, Homo sapiens
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 4822 - protein, 645 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLSIPYRHLQLIFPINSV

SEQ ID NO: 4823 - protein, 2517 aa, Homo sapiens
MVGERHAGDLMVPLGPRLQAYPEELIRQRPGHDGHPEYLIRWSVLKCGEVGKVGVEEGKAEHILMWLSAPEVYANCPGLLGERALSKGLQHEPAGVSGSFPRDPGGLDEVAMGEMEADVQALVRRAARQLAESGTPSLTAAVLHTIHVLSAYASIGPLTGVFRETGALDLLMHMLCNPEPQIRRSAGKMLQALAAHDAGSRAHVLLSLSQQDGIEQHMDFDSRYTLLELFAETTSSEEHCMAFEGIHLPQIPGKLLFSLVKRYLCVTSLLDQLNSSPELGAGDQSSPCATREKSRGQRELEFSMAVGNLISELVRSMGWARNLSEQGMSPPRPTRSIFQPYISGPSLLLPTIVTTPRRQGWVFRQRSEFSSRSGYGEYVQQTLQPGMRVRMLDDYEEISAGDEGEFRQSNNGIPPVQVFWQSTGRTYWVHWHMLEILGPEEATEDKASAAVEKGAGATVLGTAFPSWDWNPMDGLYPLPYLQPEPQKNERVGYLTQAEWWELLFFIKKLDLCEQQPIFQNLWKNLDETLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 4824 - protein, 491 aa, Homo sapiens
MEEIPAQEAAGSPRVQFQSLETQSECLSPEPQFVQDTDMEQGLTGDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 4825 - protein, 902 aa, Homo sapiens
MSEFRIHHDVNELLSLLRVHGGDGAEVYIDLLQKNRTPYVTTTVSAHSAKVKIAEFSRTPEDFLKKYDELKSKNTRNLDPLVYLLSKLTEDKETLQYLQQNAKERAELAAAAVGSSTTSINVPAAASKISMQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 4826 - protein, 762 aa, Homo sapiens
MAMQEKYPTEGISHVTSPSSDVIQKGSSLGTEWQTPVISEPFRSRFSRCSSVADSGDTAIGTSCSDIAEDFCSSSGSPPFQPIKSHVTIPTAHVMPSTLGTSPAKPNSTPVGPSSSKLPLSGLAESVGMTRNGDLGAMKHSPGLSRDLMYFSGATGENGIEQSWFPAVGHERQEEARKFDIPSMESTLNQSAMMETLYSDPHHRVRFHNPRTSTSKELYRVLPEAKKAPGSGAVFERNGPHSNSSGVLPLGLQPAPGLSKPLPSQVWQPSPDTWHPREQSCELSTCRQQLELIRLQMEQMQLQNGAICHHPAAFGPSLPILEPAQWISILNSNEHLLKEKELLIDKQRKHISQLEQKVRESELQVHSALLGRPAPFGDVCLLRLQELQRENTFLRAQFAQKTEALSREKIDLEKKLSASEVEVQLIRESLKVALQKHSEEVKKQEERVKGRDKHINNLKKKCQKESEQNREKQQRIETLERYLADLPTLEDHQKQSQQLKDSELKSTELQEKVTELESLLEETQAICREKEIQLESLRQREAEFSSAGHSLQDKQSVEETSGEGPEVEMESWQKRYDSLQKIVEKQQQKMDQLRSQVQSLEQEVAQEEGTSQALREEAQRRDSALQQLRTAVKELSVQNQDLIEKNLTLQEHLRQAQPGSPPSPDTAQLALELHQELASCLQDLQAVCSIVTQRAQGHDPNLSLLLGIHSAQHPETQLDLQKPDVIKRKLEEVQQLRRDIEDLRTTMSDRYAQDMGENCVTQ

SEQ ID NO: 4827 - protein, 480 aa, Homo sapiens
MIVADSECRAELKDYLRFAPGGVGDSGPGEEQRESRARRGPRGPSAFIPVEEVLREGAESLEQHLGLEALMSSGRVDNLAVVMGLHPDYFTSFWRLHYLLLHTDGPLASSWRHYIAIMAAARHQCSYLVGSHMAEFLQTGGDPEWLLGLHRAPEKLRKLSEINKLLAHRPWLITKEHIQALLKTGEHTWSLAELIQALVLLTHCHSLSSFVFGCGILPEGDADGSPAPQAPTPPSEQSSPPSRDPLNNSGGFESARDVEALMERMQQLQESLLRDEGTSQEEMESRFELEKSESLLVTPSADILEPSPHPDMLCFVEDPTFGYEDFTRRGAQAPPTFRAQDYTWEDHGYSLIQRLYPEGGQLLDEKFQAAYSLTYNTIAMHSGVDTSVLRRAIWNYIHCVFGIRYDDYDYGEVNQLLERNLKVYIKTVACYPEKTTRRMYNLFWRHFRHSEKVHVNLLLLEARMQAALLYALRAITRYMT

SEQ ID NO: 4828 - protein, 210 aa, Homo sapiens
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 4829 - protein, 352 aa, Homo sapiens
MTEAGKLPLPLPPRLDWFVHTQMGQLAQDGVPEWFHGAISREDAENLLESQPLGSFLIRVSHSHVGYTLSYKAQSSCCHFMVKLLDDGTFMIPGEKVAHTSLDALVTFHQQKPIEPRRELLTQPCRQKDPANVDYEDLFLYSNAVAEEAACPVSAPEEASPKPVLCHQSKERKPSAEMNRITTKEATSSCPPKSPLGETRQKLWRSLKMLPERGQRVRQQLKSHLATVNLSSLLDVRRSTVISGPGTGKGSQDHSGDPTSGDRGYTDPCVATSLKSPSQPQAPKDRKVPTRKAERSVSCIEVTPGDRSWHQMVVRALSSQESKPEHQGLAEPENDQLPEEYQQPPPFAPGYC

SEQ ID NO: 4830 - protein, 159 aa, Homo sapiens
MTHCCSPCCQPTCCRTTCWKPTTVTTCSSTPCCQPSCCVSSCCQPCCRPTCCQNTCCQPICVTSCCQPSCCSTPCCQPTCCGQTSCGSSCGQSSSCAPVYCRRTCYHPTTVCLPGCLNQSCGSNCCQPCCRPACCETTCCRTTCFQPTCVSSCCQPSCC

SEQ ID NO: 4831 - protein, 204 aa, Homo sapiens
MDPKDRKKIQFSVPAPPSQLDPRQVEMIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 4832 - protein, 686 aa, Homo sapiens
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEEAFTIPLIPLGLKETKDVDFAVVLKDFILEHYSEDGYLYEDEIADLMDLRQACRTPSRDEAGVELLMTYFIQLGFVESRFFPPTRQMGLLFTWYDSLTGVPVSQQNLLLEKASVLFNTGALYTQIGTRCDRQTQAGLESAIDAFQRAAGVLNYLKDTFTHTPSYDMSPAMLSVLVKMMLAQAQESVFEKISLPGIRNEFFMLVKVAQEAAKVGEVYQQLHAAMSQAPVKENIPYSWASLACVKAHHYAALAHYFTAILLIDHQVKPGTDLDHQEKCLSQLYDHMPEGLTPLATLKNDQQRRQLGKSHLRRAMAHHEESVREASLCKKLRSIEVLQKVLCAAQERSRLTYAQHQEEDDLLNLIDAPSVVAKTEQEVDIILPQFSKLTVTDFFQKLGPLSVFSANKRWTPPRSIRFTAEEGDLGFTLRGNAPVQVHFLDPYCSASVAGAREGDYIVSIQLVDCKWLTLSEVMKLLKSFGEDEIEMKVVSLLDSTSSMHNKSATYSVGMQKTYSMICLAIDDDDKTDKTKKISKKLSFLSWGTNKNRQKSASTLCLPSVGAARPQVKKKLPSPFSLLNSDSSWY

SEQ ID NO: 4833 - protein, 417 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 4834 - protein, 880 aa, Homo sapiens
MSQPAGGRRKPRTLGPPVCSIRPFKSSEQYLEAMKEDLAEWLRDLYGLDIDAANFLQVLETGLVLCQHANVVTDAALAFLAEAPAQAQKIPMPRVGVSCNGAAQPGTFQARDNVSNFIQWCRKEMGIQEVLMFETEDLVLRKNVKNVVLCLLELGRRAWRFGVAAPTLVQLEEEIEEEVRRELALPPPDPSPPAPPRRQPCHFRNLDQMVQSLVSHCTCPVQFSMVKVSEGKYRVGDSNTLIFIRILRNHVMVRVGGGWDTLGHYLDKHDPCRCTSLSHKPGSFLKPPAPPVQHEVRVQDGPSQTQPTMTISRSQSPPPPVDWKTYTSSDRRLRPPTPSSPRPRRERGAGTGASREMAPFLRCQERSLIPSWRQPTAGDSPPSPQSSSTQKGRDPQCTSSGKREERYPPELPRGRIPTSWVHEETDSWGTDAGNPTPQRLRAIEATTKGISARGPSPLPRSFGPAECLGLRLPLRDEAKGAFFQFREPESVRSPTPVQGLTKIPIRLPPARPPTPGRSFPGATSGSPRTELGRDPIPLRAVTVDLAGSTHGDCSVEVRQEDQQLDIQVMAEARESWDLGLQEQEGRYTPLPLGGNKEQAIYCSLEEEILGNMKLLEVRSACPQGTRSGVIPRSGVYIPRLAGQWPEPGGPYDKAIQELAQGSPSLLKVDLEAWKAAPTGSPKPAVTPGPGSLKGKLGARQSGPRTKASLSAKGTHMRKVPPQGGQDCSASTVSASPEAPTPSPLDPNSDKAKACLSKGRRTLRKPKRVPSIYKLKLRPRIRPRRDHRPEKQPSRIPRPLAYVFLGPARQPPKDRLLRAVLGSKGGEASRVDGASVGEEEEEGKEEKEPAAPLESSPQPPEGLQPHWLNQAPLPPEEESWV

SEQ ID NO: 4835 - protein, 4753 aa, Homo sapiens
MVPEERRVGLSSDETSSDSLKSWHSICVLDSKEQPLACQQKQRQFVKPVTESEQPTVLELLLAELRTLFSAVLQDSSPAAWRYLHAVLGLLPPYRELLVGHLDLLPFLEQLYCWAPWVQTHLHLDLLGAIVQAFPPDSSLLDSASHADCCPQKRRLHHRPPCPACPFVQAQWSRQQVKEELATWLRPLTLPELQRCLGIVGAQVALEEAVWLDGLSLLPLALAADIPVRYESSDTDNAEVEPVGRKETRSQLDYEVPREKAFQKSSTGFSPETSFLDSQVMTALKMERYLKKIHFLYLNVAPSRYFRPYSLMVVPPDKVNPEHYIFSPFGILHVHPVEGSETMTLGTWHHHCVLWQQLQFIPFFKYCLLRKSFTCWKKNVRLQGLHRLQKFLENHLLLAVPHFGAGLLHISRLLQELHSVSWLPQELDRCYELLDLQTALAEEKHKALRLLHRCLNLCTSILRLVHEDTYHMQQCLQERVQNCDRIRTGQGSIYLQRVQHKQLEQKLKQAEAWWLQLGKFARLVDYMICQSLISVLEEQITSFVANILQAPRQKPFLSSQLVFDDHGQLSHVPCVENMIQTLTGGLQSVKTSALQVVQSADLKTSSDSLYSEEEDEEEDSKDEFLMPKFQGQPSDAVSIFCGPNVGLVWPWKSHPIAGILEVRGCRLRGQYFPHNYKQLEEDLDNNPKIQQALNIQQVLLEGVLCKVQEFCREHHWITGIYEFLQSWGPQKLEDMRGGPIKNYVTLVSRLNVWQARVSSMPIELLTKGGLLLLSCHDVQAEMESKLNSIRKDILAHVQNECWNLSQQLMTELTDFMHIFRTINSDIHAIAQCTQKLNEANEQYVELEERMEYVRALHELIRNHFSLFSAENEALDISVRRQFGESPIPPCPPPPQPHLLHCPLLAPQLLDMWEAFQFEKSQASEFLLSKRHAIMPKLQQLMAAALAELEGLLAKALSGPFMDPTQDQRSTEHQLVSLERQFQNTVSDLSELHHAYAIFTEDETPVPLPICGTRPIVQQQRIWHLYRVISENISEWKCMAFAKFSPAMAQEKTEGWLTEAARMSTTLELHSPVLQHCMRILGEFRSYLPLLTKLGSLHPQSLNCQCLLRALGLGSLQTIELLTLGQLLTYPLLEFADRINQVWQNENERIHAQETIRRLQRYWEARQLRLLNFILHVPYEPPASERSKRQVLRSPQWEVVDKDSGTFILSDYSNLQDSIQESLQVLSKILAIEKSGDLNKIALEWVAIMHGLGALLEVWLTFQQKWIFLNKVLHEMKIQFPNADLNSRFKVMDDQYRTLMRISVADPMVLSLVVPSAERSPYFQGQQLQQLLQAGSVELEGIIMSLESVLYGVCAHFPRLFFLSDSELVALLAARLESCEAQLWVRRCFPHVHAVSFRSCPTGEKNTDDWESSPNTQTQVEALAVLGAGGEEVKLQGPLPLHPDLPKWLASLEKCLRLALVHMLQGCVAARLARGPSLGEALKQLPKQNKLYLQLYVQHWIDLVQAFPWQCVLVAEEVVWRAEMEEALLEWGTLAMVSMHMRKLEVLVNFMRAQRASQGGQSLPSVRQTSLLSALLVMAVTHRDIAQLLEQHQVSDLTDFHWVRQLKYHLGSPHIIPKSPLQSLKTIASSEPSLSPAACWIDVLGRSFLYNYEYLGPRLGPLPSLLPERPALVLLLALEEVACGTVLGPNGVGKRAIVNSLAQALGRQLVMLPCSPQIEAQCLSNYLNGALQGGAWLLLEKVHQLPPGLLSALGQRLGELHHLYAPLYQEASRNTSTIDPTQPQLLGSSFFEKHHVSVRLGYGCLLVLRALSSAVPANLHLLLRPVALALPDLRQVAELTLLGAGMRDAFQMATRLSKFFSLERELVSGPLPCRLPLLKQILEDTIRTLNVTKEEPKCQKPRSLAAIEEAALLRSPLFSILNGLHLHNLRGLLCALFPSASQVLAEPMTYKLMKPLVVEELQQVGLDPSPDILGSLEQLSQALSRASGILLLGPAGSGKTTCWHSLFKIQNRLAAMEDTSTQGCQPVEITHLYPSGLSPQEFLGWLEGSCWHHGIFPKVLRAAGQCNNMGQKRQTEESIGIQHWIICDGASNGAWLDSITCLLSELPQLSLPSGQQIARPPGTFLLMEVADTTGISPTVVGCCALVWCGGEQTWQCILSALMASLPYEYRLQHRTVAELNHMAEVLVPATLRFLTCQGVSSLLQVHGQQAVCAGVAEVTSMARILHSLLDLHLRLKEEKAPGPEDLSYSDPVAQSFRSSKSSFLNRSQVDSDDVPDKCREHLLAVSSFLFALIWGFGAHLPSRFWPIFDTFIRDSISRLSNYPEPPPSALVFDLHVSPEDGTLVPFTGQYLSSHIKGTLGTFHPSIQTERLLYVVDLLLSGGQPVLLAGEAATGKSAFVEVLVEPHHPYIYSPIHPAFSSSHLRLLLSRGIQGQTQASPQPGHHQDSKPSLLFLLEDLHLATSDPEKSCQPVLETLRQAMDGTVYAHSTLELQTLQPTVNFLATVTVPGYCERPLCPRLFRLFTVLALESMTQATLLERHVPIIQAWLERFPSVERERALARGLVRASVEAWEAVCNCFMPSPLHPHYHFSLHSVSHLLSSLQLLPNRTGSRGFVDYPNHQEHLRRVSGLRGTCLTVMMATRNVVRLWLHEAQRTFCDRLDSPRERSYCAKLLLVVAQSVFCCGPGPQHLGKDHQESEEEEEEERVPEVESEGELAQWEDFSNSNSETEEEEEPYGLQVARVSNSRDPSLTPSIGPVSRGMKESISHKIRQEKGTRASNYRLQVRRSFKTWWQKKPQMDLISPLLLPVLLLHPQEKPSDLVFSQELILGPNSETPNLYLERQWEKLEEQLATSAAQLKLSPHLARCHSMAQHVARLVRVLARPRQHGLLLSGALGTGRHTAITLASSICQAHFFHLPSGSEEAILQCLRDASWHAGMLSQPVALLVPSGVDLTTLHRLLALATSGSFPGQYTEADLDRIGEHLPRENLGVKQNIKKEMVLQRFHQQVCSHLHLFFLIGDKQAHKQLPSTLFLRLLQLATASIDRYEPWDQAALAKVAQHHLEGAQSVPLDDGSWKYPDLQASIPSVAKAMALIHLSATHYHEHLCPALPLVTPKTFLDFLDTFLMLQQQTILKIKNKAQRVQNALENLRMLIKEHGTHANLIFDLEQQLKDSGKSLSMFQQQLEQSKLLYKQQLEECRHQENLIENLARQRDALQAQREAFLEQMSKAFLEPLSQLQVADFEEIRSYRAPPESVVRVTDAMCDLFHHETGWASAKQLLCTEDFYQELVFFPKEKITDSELIKLHLILKAPGMDDAALRAVSRPAASLAAWLWAVLHYGLAHCRGLPTDLLLQQVEATLTREQARLGYYQFQAQETLEHNLALAKMVEDAQASHNCVAKTLSQAQCGQYHKWPMKAALLTPMRAWTTQLQKLKGRCMTVFGDTLLCSAAIIYLGPFPPLRRQELLDEWLALCRGFQEALGPDDVAQALKRKQKSVSIPPKNPLLATHSPFSILSLLSSESEQYQWDGNLKPQAKSAHLAGLLLRSPTHYSSCRWPLLLDPSNEALIWLDPLPLEENRSFAPALTEGRGKGLMRNQKRESKTDMKEEDDESEESNEAEDQTKEQKAEERKNEQEKEQEENEEKEEEKTESQGSKPAYETQLPSLPYLSVLSGADPELGSQLQEAAACGLPVLLTNVELGLGCEELQWLLQREQLSPPQVQPGFCLYLSTTLSLCAMEKVLGCELLKGLNVLDLGLNMEILEEQMLHEILCREYPELETRWQDLKIRALDTCKAVEAAEERLLTMLLFQNPKRQKPAKFLRNIVRAQGKLCQLRAHCEELEGQKLQEMVLWAPYRPVVWHGMAMVKALSQLQNLLPLFCMSPENWLAVTKQALDSMKPREINHGEDLASHLLQLRAHLTRQLLGSTVTALGLTQVPLVGALGALALLQATGKASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAASVFYGGPLGDTEDREALISLTQACLSPSSGSWVQPHTPQSLLATLMPLPELRELDAMAECKAQMHLLPSPPEPRLCGLSEGPQAWLLRRQSRALLSALQRSSPVWVPESRRGAQLAERRLRQRLVQVNRRLESLQDLLTHVIRQDESDAPWSVLGPNARRPLEGVLETEALELSQLVGTLQRDLDCLLQQLKGAPPCPSRRCAAVAHALWTGRLPLPWRPHAPAGPQPPWHWLRQLSRRGQLLVRYLGVGADASSDVPERVFHLSAFRHPRRLLLALRGEAALDQNVPSSNFPGSRGSVSSQLQYKRLEMNSNPLHFRVENGPNPTVPERGLLLIGLQVLHAEWDPIAGALQDSPSSQPSPLPPVSISTQAPGTSDLPAPADLTVYSCPVYMGGPLGTAKLQSRNIVMHLPLPTKLTPNTCVQRRVHVCSPPLS

SEQ ID NO: 4836 - protein, 392 aa, Homo sapiens
MDLFGDLPEPERSPRPAAGKEAQKGPLLFDDLPPASSTDSGSGGPLLFDDLPPASSGDSGSLATSISQMVKTEGKGAKRKTSEEEKNGSEELVEKKVCKASSVIFGLKGYVAERKGEREEMQDAHVILNDITEECRPPSSLITRVSYFAVFDGHGGIRASKFAAQNLHQNLIRKFPKGDVISVEKTVKRCLLDTFKHTDEEFLKQASSQKPAWKDGSTATCVLAVDNILYIANLGDSRAILCRYNEESQKHAALSLSKEHNPTQYEERMRIQKAGGNVRDGRVLGVLEVSRSIGDGQYKRCGVTSVPDIRRCQLTPNDRFILLACDGLFKVFTPEEAVNFILSCLEDEKIQTREGKSAADARYEAACNRLANKAVQRGSADNVTVMVVRIGH

SEQ ID NO: 4837 - protein, 730 aa, Homo sapiens
MFGRKRSVSFGGFGWIDKTMLASLKVKKQELANSSDATLPDRPLSPPLTAPPTMKSSEFFEMLEKMQGIKLEEQKPGPQKNKDDYIPYPSIDEVVEKGGPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILRSKLKTVHERIPLAGLSKLPSVPQIAKAFCDDAVGLRFNPVLYPKASQMIVSYDEHEVNNTFKFGVIYQKARQTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 4838 - protein, 369 aa, Homo sapiens
MWSGRKLGSSGGWFLRVLGPGGCNTKAARPLISSAVYVKNQLSGTLQIKPGVFNEYRTIWFKSYRTIFSCLNRIKSFRYPWARLYSTSQTTVDSGEVKTFLALAHKWWDEQGVYAPLHSMNDLRVPFIRDNLLKTIPNHQPGKPLLGMKILDVGCGGGLLTEPLGRLGASVIGIDPVDENIKTAQCHKSFDPVLDKRIEYRVCSLEEIVEETAETFDAVVASEVVEHVIDLETFLQCCCQVLKPGGSLFITTINKTQLSYALGIVFSEQIASIVPKGTHTWEKFVSPETLESILESNGLSVQTVVGMLYNPFSGYWHWSENTSLNYAAYAVKSRVQEHPASAEFVLKGETEELQANACTNPAVHEKLKK

SEQ ID NO: 4839 - protein, 593 aa, Homo sapiens
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKKK

SEQ ID NO: 4840 - protein, 1151 aa, Homo sapiens
MMAAALGPPEVIAQLENAAKVLMAPPSMVNNEQRQHAEHIFLSFRKSKSPFAVCKHILETSKVDYVLFQAATAIMEAVVREWILLEKGSIESLRTFLLTYVLQRPNLQKYVREQILLAVAVIVKRGSLDKSIDCKSIFHEVSQLISSGNPTVQTLACSILTALLSEFSSSSKTSNIGLSMEFHGNCKRVFQEEDLRQIFMLTVEVLQEFSRRENLNAQMSSVFQRYLALANQVLSWNFLPPNLGRHYIAMFESSQNVLLKPTESWRETLLDSRVMELFFTVHRKIREDSDMAQDSLQCLAQLASLHGPIFPDEGSQVDYLAHFIEGLLNTINGIEIEDSEAVGISSIISNLITVFPRNVLTAIPSELFSSFVNCLTHLTCSFGRSAALEEVLDKDDMVYMEAYDKLLESWLTLVQDDKHFHKGFFTQHAVQVFNSYIQCHLAAPDGTRNLTANGVASREEEEISELQEDDRDQFSDQLASVGMLGRIAAEHCIPLLTSLLEERVTRLHGQLQRHQQQLLASPGSSTVDNKMLDDLYEDIHWLILVTGYLLADDTQGETPLIPPEIMEYSIKHSSEVDINTTLQILGSPGEKASSIPGYNRTDSVIRLLSAILRVSEVESRAIRADLTHLLSPQMGKDIVWFLKRWAKTYLLVDEKLYDQISLPFSTAFGADTEGSQWIIGYLLQKVISNLSVWSSEQDLANDTVQLLVTLVERRERANLVIQCENWWNLAKQFASRSPPLNFLSSPVQRTLMKALVLGGFAHMDTETKQQYWTEVLQPLQQRFLRVINQENFQQMCQQEEVKQEITATLEALCGIAEATQIDNVAILFNFLMDFLTNCIGLMEVYKNTPETVNLIIEVFVEVAHKQICYLGESKAMNLYEACLTLLQVYSKNNLGRQRIDVTAEEEQYQDLLLIMELLTNLLSKEFIDFSDTDEVFRGHEPGQAANRSVSAADVVLYGVNLILPLMSQDLLKFPTLCNQYYKLITFICEIFPEKIPQLPEDLFKSLMYSLELGMTSMSSEVCQLCLEALTPLAEQCAKAQETDSPLFLATRHFLKLVFDMLVLQKHNTEMTTAAGEAFYTLVCLHQAEYSELVETLLSSQQDPVIYQRLADAFNKLTASSTPPTLDRKQKMAFLKSLEEFMANVGGLLCVK

SEQ ID NO: 4841 - protein, 525 aa, Homo sapiens
MAAGGSGGRASCPPGVGVGPGTGGSPGPSANAAATPAPGNAAAAAAAAAAAAAAPGPTPPAPPGPGTDAQAAGAERAEEAAGPGAAALQREAAYNWQASKPTVQERFAFLFNNEVLCDVHFLVGKGLSSQRIPAHRFVLAVGSAVFDAMFNGGMATTSTEIELPDVEPAAFLALLKFLYSDEVQIGPETVMTTLYTAKKYAVPALEAHCVEFLKKNLRADNAFMLLTQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHTDSNTVLGQNDTGFSCDGSASTFRVMFKEPVEVLPNVNYTACATLKGPDSHYGTKGLRKVTHESPTTGAKTCFTFCYAAGNNNGTSVEDGQIPEVIFYT

SEQ ID NO: 4842 - protein, 174 aa, Homo sapiens
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 4843 - protein, 418 aa, Homo sapiens
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 4844 - protein, 347 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRTFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 4845 - protein, 211 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 4846 - protein, 315 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDGDDDAEEMEAKAED

SEQ ID NO: 4847 - protein, 105 aa, Homo sapiens
MAGQEDPVQREIHQDWANREYIEIITSSIKKIADFLNSFDMSCRSRLATLNEKLTALERRIEYIEARVTKGETLRTVPCCCWEVALHNTGHMGKAPAAFSSFLSP

SEQ ID NO: 4848 - protein, 633 aa, Homo sapiens
MAAAAAAATTAACSSGSAGTDAAGASGLQQPPPQPQPQPAAAAPAQPPPEPPRKPRMDPRRRQAALSFLTNISLDGRLPPQDAEWGGGEEGGAAKPGAGGACGARTRFSLLAAAERGGCIALAAPGTPAAGLAAGSGPCLPQPSSLPPLIPGGHATVSGPGVARGFASPLGAGRASGEQWQPPRPAPLAACAQLQLLDGSGAAGQEELEEDDAFISVQVPAAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 4849 - protein, 1140 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQIELREREIERLSVALDGGRSPDVLSLESRNKTNEKLIAHLNIQVDFLQQANKDLEKRIRELMETKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKEKLTLSESKLTSQSRENTMLRAKVAQLQTDYDALKRQISTERYERERAIQEMRRHGLATPPLSSTLRSPSHSPEHRNV

SEQ ID NO: 4850 - protein, 503 aa, Homo sapiens
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSSIHERRNSGYQGYSDYDGND

SEQ ID NO: 4851 - protein, 270 aa, Homo sapiens
MEAEELEQEREQLRLQLWEAYCQVRYLCSHLRGNDSADSAVSTDSSMDESSETSSAKDVPAGSLRTALNELKRLIQSIVDGMEPTGSRRLDDDSLEEQIRQTSEDSRALRELMEGERGKLRQSLEELQRLHSQVTLLSVEMTALKEERDRLRVTSEDKEPKEQLQKAIRDRDEAIAKKNAVELELAKCRMDMMSLNSQLLDAIQQKLNLSQQLEAWQDDMHRVIDRQLMDTHLKERSQPAAALCRGHSAGRGDEPSIAEGKRLFSFFRKI

SEQ ID NO: 4852 - protein, 792 aa, Homo sapiens
MLPAGEIGASPAAPCCSESGDERKNLEEKSDINVTVLIGSKQVSEGTDNGDLPSYVSAFIEKEVGNDLKSLKKLDKLIEQRTVSKMQLEEQVLTISSEIPKRIRSALKNAEESKQFLNQFLEQETHLFSAINSHLLTAQPWMDDLGTMISQIEEIERHLAYLKWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSDELLTEPKQLPEKYSLPASPSVILPIQVMLTPLQKRFRYHFRGNRQTNVLSKPEWYLAQVLMWIGNHTEFLDEKIQPILDKVGSLVNARLEFSRGLMMLVLEKLATDIPCLLYDDNLFCHLVDEVLLFERELHSVHGYPGTFASCMHILSEETCFQRWLTVERKFALQKMDSMLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQQAALEVFAENNTLSKLQLGQLASMESSVFDDMINLLERLKHDMLTRQVDHVFREVKDAAKLYKKERWLSLPSQSEQAVMSLSSSACPLLLTLRDHLLQLEQQLCFSLFKIFWQMLVEKLDVYIYQEIILANHFNEGGAAQLQFDMTRNLFPLFSHYCKRPENYFKHIKEACIVLNLNVGSALLLKDVLQSASGQLPATAALNEVGIYKLAQQDVEILLNLRTNWPNTGK

SEQ ID NO: 4853 - protein, 355 aa, Homo sapiens
VRGVRAATAAAVAATAASGLSRREAGGRAGAAAAVVRPPGRKCGRCRRLANFPGRKRRRRRRKGLGATTGGCGEAVSSLHPAPHSPSSVRPAGRRARRQRRGAGSAERPMSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 4854 - protein, 125 aa, Homo sapiens
MLSRLLKEHQAKQNERKELQEKRRREAITAATCLTEALVDHLNVGVAQAYMNQRKLDHEVKTLQVQAAQFAKQTGQWIGMVENFNQALKEIGDVENWARSIELDMRTIATALEYVYKGQLQSAPS

SEQ ID NO: 4855 - protein, 778 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 4856 - protein, 600 aa, Homo sapiens
MSCRSYRVSSGHRVGNFSSCSAMTPQNLNRFRANSVSCWSGPGFRGLGSFGSRSVITFGSYSPRIAAVGSRPIHCGVRFGAGCGMGFGDGRGVGLGPRADSCVGLGFGAGSGIGYGFGGPGFGYRVGGVGVPAAPSITAVTVNKSLLTPLNLEIDPNAQRVKKDEKEQIKTLNNKFASFIDKVRFLEQQNKLLETKWSFLQEQKCIRSNLEPLFESYITNLRRQLEVLVSDQARLQAERNHLQDVLEGFKKKYEEEVVCRANAENEFVALKKDVDAAFMNKSDLEANVDTLTQEIDFLKTLYMEEIQLLQSHISETSVIVKMDNSRDLNLDGIIAEVKAQYEEVARRSRADAEAWYQTKYEEMQVTAGQHCDNLRNIRNEINELTRLIQRLKAEIEHAKAQRAKLEAAVAEAEQQGEATLSDAKCKLADLECALQQAKQDMARQLCEYQELMNAKLGLDIEIATYRRLLEGEESRLCEGVGPVNISVSSSRGGLVCGPEPLVAGSTLSRGGVTFSGSSSVCATSGVLASCGPSLGGARVAPATGDLLSTGTRSGSMLISEACVPSVPCPLPTQGGFSSCSGGRSSSVRFVSTTTSCRTKY

SEQ ID NO: 4857 - protein, 513 aa, Homo sapiens
MSYHSFQPGSRCGSQSFSSYSAVMPRMVTHYAVSKGPCRPGGGRGLRALGCLGSRSLCNVGFGRPRVASRCGGTLPGFGYRLGATCGPSACITPVTINESLLVPLALEIDPTVQRVKRDEKEQIKCLNNRFASFINKVRFLEQKNKLLETKWNFMQQQRCCQTNIEPIFEGYISALRRQLDCVSGDRVRLESELCSLQAALEGYKKKYEEELSLRPCVENEFVALKKDVDTAFLMKADLETNAEALVQEIDFLKSLYEEEICLLQSQISETSVIVKMDNSRELDVDGIIAEIKAQYDDIASRSKAEAEAWYQCRYEELRVTAGNHCDNLRNRKNEILEMNKLIQRLQQETENVKAQRCKLEGAIAEAEQQGEAALNDAKCKLAGLEEALQKAKQDMACLLKEYQEVMNSKLGLDIEIATYRRLLEGEEHRLCEGIGPVNISVSSSKGAFLYEPCGVSTPVLSTGVLRSNGGCSIVGTGELYVPCEPQGLLSCGSGRKSSMTLGAGGSSPSHKH

SEQ ID NO: 4858 - protein, 543 aa, Homo sapiens
MMPTPVILLKEGTDSSQGIPQLVSNISACQVIAEAVRTTLGPRGMDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 4859 - protein, 492 aa, Homo sapiens
MAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 4860 - protein, 179 aa, Homo sapiens
MDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRAAPLKEARHLLTANSIDPSAALVLLIEFLLLTLVTGAAAPGLDACGHQRNMRDEINSERR

SEQ ID NO: 4861 - protein, 1199 aa, Homo sapiens
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSSSCYLHSLPDLFNSTLLYRRSSYRQKPYQQLESFCLRSSPSEKSPFSLPQKSLPVSLTANKATSSMVFSMAQPMASSSTEPYLCLAAAGENPSGKSLASAISGKIPSPLSSSYKPMLNNNSFMWPNSTPVPLLQTTQGLKPVSPPKIQPVSWHHSGGTGDCAPQPVDHKVPKSIGTVPADASAHIALSTASSHDTSTTSVASSWYNRNNLAMRAEPLSCALDDSSDSQDPTKEIRFTEAVRKLTARGFEKMPRQGCQLEQSSFLNPSFQWNVLNRSRRWKPPAVNQQFPQEDAGSVRRVLPGASDTLGLDNTVFCTKRISIHLLASHASGLNHNPACESVIDSSAFGEGKAPGPPFPQTLGIANVATRLSSIQLGQSEKERPEEARELDSSDRDISSATDLQPDQAETEDTEEELVDGLEDCCSRDENEEEEGDSECSSLSAVSPSESVAMISRSCMEILTKPLSNHEKVVRPALIYSLFPNVPPTIYFGTRDERVEKLPWEQRKLLRWKMSTVTPNIVKQTIGRSHFKISKRNDDWLGCWGHHMKSPSFRSIREHQKLNHFPGSFQIGRKDRLWRNLSRMQSRFGKKEFSFFPQSFILPQDAKLLRKAWESSSRQKWIVKPPASARGIGIQVIHKWSQLPKRRPLLVQRYLHKPYLISGSKFDLRIYVYVTSYDPLRIYLFSDGLVRFASCKYSPSMKSLGNKFMHLTNYSVNKKNAEYQANADEMACQGHKWALKALWNYLSQKGVNSDAIWEKIKDVVVKTIISSEPYVTSLLKMYVRRPYSCHELFGFDIMLDENLKPWVLEVNISPSLHSSSPLDISIKGQMIRDLLNLAGFVLPNAEDIISSPSSCSSSTTSLPTSPGDKCRMAPEHVTAQKMKKAYYLTQKIPDQDFYASVLDVLTPDDVRILVEMEDEFSRRGQFERIFPSHISSRYLRFFEQPRYFNILTTQWEQKYHGNKLKGVDLLRSWCYKGFHMGVVSDSAPVWSLPTSLLTISKDDVILNAFSKSETSKLGKQSSCEVSLLLSEDGTTPKSKKTQAGLSPYPQKPSSSKDSEDTSKEPSLSTQTLPVIKCSGQTSRLSASSTFQSISDSLLAVSP

SEQ ID NO: 4862 - protein, 923 aa, Homo sapiens
MLRRGSQALRRFSTGRVYFKNKLKLALIGQSLFGQEVYSHLRKEGHRVVGVFTVPDKDGKADPLALAAEKDGTPVFKLPKWRVKGKTIKEVAEAYRSVGAELNVLPFCTQFIPMDIIDSPKHGSIIYHPSILPRHRGASAINWTLIMGDKKAGFSVFWADDGLDTGPILLQRSCDVEPNDTVDALYNRFLFPEGIKAMVEAVQLIADGKAPRIPQPEEGATYEGIQKKENAEISWDQSAEVLHNWIRGHDKVPGAWTEINGQMVTFYGSTLLNSSVPPGEPLEIKGAKKPGLVTKNGLVLFGNDGKALTVRNLQFEDGKMIPASQYFSTGETSVVELTAEEVKVAETIKVIWAGILSNVPIIEDSTDFFKSGASSMDVARLVEEIRQKCGGLQLQNEDVYMATKFEGFIQKVVRKLRGEDQEVELVVDYISKEVNEIMVKMPYQCFINGQFTDADDGKTYDTINPTDGSTICKVSYASLADVDKAVAAAKDAFENGEWGRMNARERGRLMYRLADLLEENQEELATIEALDSGAVYTLALKTHIGMSVQTFRYFAGWCDKIQGSTIPINQARPNRNLTFTKKEPLGVCAIIIPWNYPLMMLAWKSAACLAAGNTLVLKPAQVTPLTALKFAELSVKAGFPKGVINIIPGSGGIAGQRLSEHPDIRKLGFTGSTPIGKQIMKSCAVSNLKKVSLELGGKSPLIIFNDCELDKAVRMGMGAVFFNKGENCIAAGRLFVEESIHDEFVTRVVEEIKKMKIGDPLDRSTDHGPQNHKAHLEKLLQYCETGVKEGATLVYGGRQVQRPGFFMEPTVFTDVEDYMYLAKEESFGPIMVISKFQNGDIDGVLQRANSTEYGLASGVFTRDINKAMYVSEKLEAGTVFINTYNKTDVAAPFGGVKQSGFGKDLGEEALNEYLKTKTVTLEY

SEQ ID NO: 4863 - protein, 440 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALRNPTENT

SEQ ID NO: 4864 - protein, 423 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 4865 - protein, 440 aa, Homo sapiens
MMADEEEEVKPILQKLQELVDQLYSFRDCYFETHSVEDAGRKQQDVQKEMEKTLQQMEEVVGSVQGKAQVLMLTGKALNVTPDYSPKAEELLSKAVKLEPELVEAWNQLGEVYWKKGDVAAAHTCFSGALTHCRNKVSLQNLSMVLRQLRTDTEDEHSHHVMDSVRQAKLAVQMDVHDGRSWYILGNSYLSLYFSTGQNPKISQQALSAYAQAEKVDRKASSNPDLHLNRATLHKYEESYGEALEGFSRAAALDPAWPEPRQREQQLLEFLDRLTSLLESKGKVKTKKLQSMLGSLRPAHLGPCSDGHYQSASGQKVTLELKPLSTLQPGVNSGAVILGKVVFSLTTEEKVPFTFGLVDSDGPCYAVMVYNIVQSWGVLIGDSVAIPEPNLRLHRIQHKGKDYSFSSVRVETPLLLVVNGKPQGSSSQAVATVASRPQCE

SEQ ID NO: 4866 - protein, 446 aa, Homo sapiens
MEETIKDPPTSAVLLDHCHFSQVIFNSVEKFYIPGGDVTCHYTFTQHFIPRRKDWIGIFRVGWKTTREYYTFMWVTLPIDLNNKSAKQQEVQFKAYYLPKDDEYYQFCYVDEDGVVRGASIPFQFRPENEEDILVVTTQGEVEEIEQHNKELCKENQELKDSCISLQKQNSDMQAELQKKQEELETLQSINKKLELKVKEQKDYWETELLQLKEQNQKMSSENEKMGIRVDQLQAQLSTQEKEMEKLVQGDQDKTEQLEQLKKENDHLFLSLTEQRKDQKKLEQTVEQMKQNETTAMKKQQELMDENFDLSKRLSENEIICNALQRQKERLEGENDLLKRENSRLLSYMGLDFNSLPYQVPTSDEGGARQNPGLAYGNPYSGIQESSSPSPLSIKKCPICKADDICDHTLEQQQMQPLCFNCPICDKIFPATEKQIFEDHVFCHSL

SEQ ID NO: 4867 - protein, 442 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 4868 - protein, 425 aa, Homo sapiens
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQPIWKPFPNQDSDSVVLSGTDSELHIPRVCEFCQAVFPPSITSRGDFLRHLNSHFNGET

SEQ ID NO: 4869 - protein, 684 aa, Homo sapiens
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEASKSISRQSEKAHSSGKLQKTVSYPDVSLEEQEKMDLKTSRELCSRLDASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 4870 - protein, 359 aa, Homo sapiens
MSYRRELEKYRDLDEDEILGALTEEELRTLENELDELDPDNALLPAGLRQKDQTTKAPTGPFKREELLDHLEKQAKEFKDREDLVPYTGEKRGKVWVPKQKPLDPVLESVTLEPELEEALANASDAELCDIAAILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 4871 - protein, 646 aa, Homo sapiens
MEERGSPDGDLARSLEQGPEGPETPIQVVLRVRPMSAAELRRGQQSVLHCSGTRTLQGGPEVAFRFGAVLDAARTQEDVFRACGVRRLGELALRGFSCTVFTFGQTGSGKTYTLTGPPPQGEGVPVPPSLAGIMQRTFAWLLDRVQHLGAPVTLRASYLEIYNEQVRDLLSLGSPRPLPVRWNKTRGFYVEQLRVVEFGSLEALMELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQVLDPEASGGRPPSARPPPWAPPCSPGSAKCPRERSHSDWTQTRVLAEMLTEEEVVPSAPPLPVRPPKTSPGLRGGAGVPNLAQRLEALRDQIGSSLRRGRSQPPCSEGARSPGQVLPPH

SEQ ID NO: 4872 - protein, 153 aa, Homo sapiens
MARNTLSSRFRRVDIDEFDENKFVDEQEEAAAAAAEPGPDPSEVDGLLRQGDMLRAFHAALRNSPVNTKNQAVKERAQGVVLKVLTNFKSSEIEQAVQSLDRNGVDLLMKYIYKGFEKPTENSSAVLLQWHEKALAVGGLGSIIRVLTARKTV

SEQ ID NO: 4873 - protein, 1105 aa, Homo sapiens
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPAIRTLSARAAAAFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDEDWVNADEMEEDDFDSNAVAAESALDRLACGLGGKVVLPMTKEHIMQMLQSPDWKYRHAGLMALSAIGEGCHQQMESILDETVNSVLLFLQDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLSFLCDLIESNHPVVIGPNNSNLPKIISIIAEGKINETINYEDPCAKRLANVVRQVQTSEDLWLECVSQLDDEQQEALQELLNFA

SEQ ID NO: 4874 - protein, 637 aa, Homo sapiens
MEVTGFGVTRPGKVPQARMSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 4875 - protein, 1321 aa, Homo sapiens
MQCLAAALKDETNMSGGGEQADILPANYVVKDRWKVLKKIGGGGFGEIYEAMDLLTRENVALKVESAQQPKQVLKMEVAVLKKLQGKDHVCRFIGCGRNEKFNYVVMQLQGRNLADLRRSQPRGTFTLSTTLRLGKQILESIEAIHSVGFLHRDIKPSNFAMGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPTVRPRGRSMQALAEEDLQHLPPQPLPPQLSQGDGRSETSQPPTPGSPSHSPLHSGPRPRRRESDPTGPQRQVFSVAPPFEVNGLPRAVPLSLPYQDFKRDLSDYRERARLLNRVRRVGFSHMLLTTPQVPLAPVQPQANGKEEEEEEEEDEEEEEEDEEEEEEEEEEEEEEEEEEEEEEEAAAAVALGEVLGPRSGSSSEGSERSTDRSQEGAPSTLLADDQKESRGRASMADGDLEPEEGSKTLVLVSPGDMKKSPVTAELAPDPDLGTLAALTPQHERPQPTGSQLDVSEPGTLSSVLKSEPKPPGPGAGLGAGTVTTGVGGVAVTSSPFTKVERTFVHIAEKTHLNVMSSGGQALRSEEFSAGGELGLELASDGGAVEEGARAPLENGLALSGLNGAEIEGSALSGAPRETPSEMATNSLPNGPALADGPAPVSPLEPSPEKVATISPRRHAMPGSRPRSRIPVLLSEEDTGSEPSGSLSAKERWSKRARPQQDLARLVMEKRQGRLLLRLASGASSSSSEEQRRASETLSGTGSEEDTPASEPAAALPRKSGRAAATRSRIPRPIGLRMPMPVAAQQPASRSHGAAPALDTAITSRLQLQTPPGSATAADLRPKQPPGRGLGPGRAQAGARPPAPRSPRLPASTSAARNASASPRSQSLSRRESPSPSHQARPGVPPPRGVPPARAQPDGTPSPGGSKKGPRGKLQAQRATTKGRAGGAEGRAGAR

SEQ ID NO: 4876 - protein, 605 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 4877 - protein, 450 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVISYEMLHVTPPMSPPDVLKTSPVADAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLRGYWGGPAFLRKLFHLGMS

SEQ ID NO: 4878 - protein, 1747 aa, Homo sapiens
MDGVSSEANEENDNIERPVRRRHSSILKPPRSPLQDLRGGNERVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEPKKNVGTRRRRYS

SEQ ID NO: 4879 - protein, 686 aa, Homo sapiens
MIPGKYRSVSGRAANNVNCGLHLVIQTSSLPEKNKVEFKLNKDTSSFPGRLLQHDLERNYSSRQGDHINLVSSSLSSFPILQRSSEEKILYSDRLSLERQKLTVCPIINGEDHLRLLNFQHNFITRIQNISNLQKLISLDLYDNQIEEISGLSTLRCLRVLLLGKNRIKKISNLENLKSLDVLDLHGNQITKIENINHLCELRVLNLARNFLSHVDNLNGLDSLTELNLRHNQITFVRDVDNLPCLQHLFLSFNNISSFDSVSCLADSSSLSDITFDGNPIAQESWYKHTVLQNMMQLRQLDMKRITEEERRMASVLAKKEEEKKRESHKQSLLKEKKRLTINNVARQWDLQQQRVANIATNEDRKDSDSPQDPCQIDGSTLSAFPEETGPLDSGLNNALQGLSVIDTYLVEVDGDTLSLYGSGALESLDRNWSVQTAGMITTVSFTFIEFDEIVQVLPKLKIKFPNSLHLKFKETNLVMLQQFNALAQLRRIDQLTIDPQGNPVVNFTLWKYYVLFRLSHFSMQKINGTEVTQNDMIMAERLFGILAHVASSELPQYRLISILGDARKKQFRYLLESKGKKPGIINEENNDSKRLVGENTNRATLNYTTRDFYNEKLEEIKEKKKFCKTYIEDLVKEATEINMKNEALQKLWPQMFIELVRDAVIEIRNKNSYMKLCLQQITDQK

SEQ ID NO: 4880 - protein, 84 aa, Homo sapiens
MPYLLISTQIRMEVGPTMVGDEQSDPELMQHLGASKRRALGNNFYEYYVDDPPRIVLDKLERRGFRVLSMTGVGQTLVWCLHKE

SEQ ID NO: 4881 - protein, 887 aa, Homo sapiens
MPSLPQEGVIQGPSPLDLNTELPYQSTMKRKVRKKKKKGTITANVAGTKFEIVRLVIDEMGFMKTPDEDETSNLIWCDSAVQQEKISELQNYQRINHFPGMGEICRKDFLARNMTKMIKSRPLDYTFVPRTWIFPAEYTQFQNYVKELKKKRKQKTFIVKPANGAMGHGISLIRNGDKLPSQDHLIVQEYIEKPFLMEGYKFDLRIYILVTSCDPLKIFLYHDGLVRMGTEKYIPPNESNLTQLYMHLTNYSVNKHNEHFERDETENKGSKRSIKWFTEFLQANQHDVAKFWSDISELVVKTLIVAEPHVLHAYRMCRPGQPPGSESVCFEVLGFDILLDRKLKPWLLEINRAPSFGTDQKIDYDVKRGVLLNALKLLNIRTSDKRRNLAKQKAEAQRRLYGQNSIKRLLPGSSDWEQQRHQLERRKEELKERLAQVRKQISREEHENRHMGNYRRIYPPEDKALLEKYENLLAVAFQTFLSGRAASFQRELNNPLKRMKEEDILDLLEQCEIDDEKLMGKTTKTRGPKPLCSMPESTEIMKRPKYCSSDSSYDSSSSSSESDENEKEEYQNKKREKQVTYNLKPSNHYKLIQQPSSIRRSVSCPRSISAQSPSSGDTRPFSAQQMISVSRPTSASRSHSLNRASSYMRHLPHSNDACSTNSQVSESLRQLKTKEQEDDLTSQTLFVLKDMKIRFPGKSDAESELLIEDIIDNWKYHKTKVASYWLIKLDSVKQRKVLDIVKTSIRTVLPRIWKVPDVEEVNLYRIFNRVFNRLLWSRGQGLWNCFCDSGSSWESIFNKSPEVVTPLQLQCCQRLVELCKQCLLVVYKYATDKRGSLSGIGPDWGNSRYLLPGSTQFFLRTPTYNLKYNSPGMTRSNVLFTSRYGHL

SEQ ID NO: 4882 - protein, 379 aa, Homo sapiens
MAGPRVEVDGSIMEGGGQILRVSTALSCLLGLPLRVQKIRAGRSTPGLSSGGWKSKIKVLTRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 4883 - protein, 351 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 4884 - protein, 265 aa, Homo sapiens
MCTSETFQALDTFEARHDDIVLASYPKCGSNWILHIVSELIYAVSKKKYKYPEFPVLECGDSEKYQRMKGFPSPRILATHLHYDKLPGSIFENKAKILVIFRNPKDTAVSFLHFHNDVPDIPSYGSWDEFFRQFMKGQVSWGRYFDFAINWNKHLDGDNVKFILYEDLKENLAAGIKQIAEFLGFFLTGEQIQTISVQSTFQAMRAKSQDTHGAVGPFLFRKGEVGDWKNLFSEIQNQEMDEKFKECLAGTSLGAKLKYESYCQG

SEQ ID NO: 4885 - protein, 1780 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 4886 - protein, 456 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILASQ

SEQ ID NO: 4887 - protein, 209 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSVDIEVDLIRFSF

SEQ ID NO: 4888 - protein, 1572 aa, Homo sapiens
MASSAREHLLFVRRRNPQMRYTLSPENLQSLAAQSSMPENMTLQRANSDTDLVTSESRSSLTASMYEYTLGQAQNLIIFWDIKEEVDPSDWIGLYHIDENSPANFWDSKNRGVTGTQKGQIVWRIEPGPYFMEPEIKICFKYYHGISGALRATTPCITVKNPAVMMGAEGMEGGASGNLHSRKLVSFTLSDLRAVGLKKGMFFNPDPYLKMSIQPGKKSSFPTCAHHGQERRSTIISNTTNPIWHREKYSFFALLTDVLEIEIKDKFAKSRPIIKRFLGKLTIPVQRLLERQAIGDQMLSYNLGRRLPADHVSGYLQFKVEVTSSVHEDASPEAVGTILGVNSVNGDLGSPSDDEDMPGSHHDSQVCSNGPVSEDSAADGTPKHSFRTSSTLEIDTEELTSTSSRTSPPRGRQDSLNDYLDAIEHNGHSRPGTATCSERSMGASPKLRSSFPTDTRLNAMLHIDSDEEDHEFQQDLGYPSSLEEEGGLIMFSRASRADDGSLTSQTKLEDNPVENEEASTHEAASFEDKPENLPELAESSLPAGPAPEEGEGGPEPQPSADQGSAELCGSQEVDQPTSGADTGTSDASGGSRRAVSETESLDQGSEPSQVSSETEPSDPARTESVSEASTRPEGESDLECADSSCNESVTTQLSSVDTRCSSLESARFPETPAFSSQEEEDGACAAEPTSSGPAEGSQESVCTAGSLPVVQVPSGEDEGPGAESATVPDQEELGEVWQRRGSLEGAAAAAESPPQEEGSAGEAQGTCEGATAQEEGATGGSQANGHQPLRSLPSVRQDVSRYQRVDEALPPNWEARIDSHGRIFYVDHVNRTTTWQRPTAPPAPQVLQRSNSIQQMEQLNRRYQSIRRTMTNERPEENTNAIDGAGEEADFHQASADFRRENILPHSTSRSRITLLLQSPPVKFLISPEFFTVLHSNPSAYRMFTNNTCLKHMITKVRRDTHHFERYQHNRDLVGFLNMFANKQLELPRGWEMKHDHQGKAFFVDHNSRTTTFIDPRLPLQSSRPTSALVHRQHLTRQRSHSAGEVGEDSRHAGPPVLPRPSSTFNTVSRPQYQDMVPVAYNDKIVAFLRQPNIFEILQERQPDLTRNHSLREKIQFIRTEGTPGLVRLSSDADLVMLLSLFEEEIMSYVPPHALLHPSYCQSPRGSPVSSPQNSPGTQRANARAPAPYKRDFEAKLRNFYRKLETKGYGQGPGKLKLIIRRDHLLEDAFNQIMGYSRKDLQRNKLYVTFVGEEGLDYSGPSREFFFLVSRELFNPYYGLFEYSANDTYTVQISPMSAFVDNHHEWFRFSGRILGLALIHQYLLDAFFTRPFYKALLRILCDLSDLEYLDEEFHQSLQWMKDNDIHDILDLTFTVNEEVFGQITERELKPGGANIPVTEKNKKEYIERMVKWRIERGVVQQTESLVRGFYEVVDARLVSVFDARELELVIAGTAEIDLSDWRNNTEYRGGYHDNHIVIRWFWAAVERFNNEQRLRLLQFVTGTSSIPYEGFASLRGSNGPRRFCVEKWGKITALPRAHTCFNRLDLPPYPSFSMLYEKLLTAVEETSTFGLE

SEQ ID NO: 4889 - protein, 401 aa, Homo sapiens
MSCRCWISRHPSYEGWNLQSIIFHKQIRGVDLESTFVTKFGNNCSLRLNETVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 4890 - protein, 475 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPGHPVQFYSMNRPASRHTPPTIGGSLPYRRPPSITSQTSLQNQMNGGPFYSQNPVSLAPPPPSILQVTPQLPLMGFVARVQENISDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 4891 - protein, 299 aa, Homo sapiens
MKMGGLPRTTPPTQKPPSPPMSGKGTLGSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 4892 - protein, 641 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRKPPGPPPGPPPPQVVQMYGRKVGFALDLPPRRRDEDMLYSPELAQRGHDDDVSSTSEDDGYPEDMDQDKHDDSTDDSDTDKSDGESDGDEFVHRDNGERDNNEEKKSGLSVRFADMPGKSRKKKKNMKELTPLQAMMLRMAGQEIPEEGREVEEFSEDDDEDDSDDSEAEKQSQKQHKEESHSDGTSTASSQQQAPPQSVPPSQIQAPPMPGPPPLGPPPAPPLRPPGPPTGLPPGPPPGAPPFLRPPGMPGLRGPLPRLLPPGPPPGRPPGPPPGPPPGLPPGPPPRGPPPRLPPPAPPGIPPPRPGMMRPPLVPPLGPAPPGLFPPAPLPNPGVLSAPPNLIQRPKADDTSAATIEKKATATISAKPQITNPKAEITRFVPTALRVRRENKGATAAPQRKSEDDSAVPLAKAAPKSGPSVPVSVQTKDDVYEAFMKEMEGLL

SEQ ID NO: 4893 - protein, 1472 aa, Homo sapiens
MKGSEVSLEKKKKIKMPVKRLREVVSQNHGDHLVLLKDELPCVPPALSANKRLPVGTGTSLNGTSRGSSDLTSARNCYQPLLENPMVSESDFSKDVAVQVLPLDKIEENNKQKANDIFISQYTMGQKDALRTVLKQKAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGGKAVPLSASQMPPAKMSVMLPSVNLEDCSQSLSLSTMQEDMESSGADTF

SEQ ID NO: 4894 - protein, 661 aa, Homo sapiens
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLIRWMLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKKRSNSEHRSHSTGFIEGVVGPALPSTFKMEQDLCRTGVLLPSSPEAEVPGKLSPKQSATMPKKGILKKTQQRESGYYSSPERSESSELLDSNDVMGSSIPSPSPPDPARVTSHSLSCRRKGILKHSSKYSAGTMDPALVSPEMPTLESLSEPGVPAEGLSRSYSRPSSVISDDSVLSSDSFDLLDLQENRPARQRIRSCVSAENFLQIQDFEGLQNRPRPQYLKRYRNRLADSSFSLLTDMDDVTQVYKQALEICSKLN

SEQ ID NO: 4895 - protein, 200 aa, Homo sapiens
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 4896 - protein, 1770 aa, Homo sapiens
MPRRRKNLGGNPFRKTANPKEVVVSSVASREEPTTTLPSMGETKVDQEELFTSISEIFSDLDPDVVYLMLSECDFKVENAMDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALESNYPEDSLLSSSLNVASDSIAGCSSLNQKQKELLESECVEAQFSEAPVDLDASEPQACLNLPGLDLPGTGGDQKSTRVSDVFLPSEGFNFKPHKHPELPTKGKDVSYCPVLAPLPLLLPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKPKKLKETEETPSELSFQDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 4897 - protein, 453 aa, Homo sapiens
MDWKEVLRRRLATPNTCPNKKKSEQELKDEEMDLFTKYYSEWKGGRKNTNEFYKTIPRFYYRLPAEDEVLLQKLREESRAVFLQRKSRELLDNEELQNLWFLLDKHQTPPMIGEEAMINYENFLKVGEKAGAKCKQFFTAKVFAKLLHTDSYGRISIMQFFNYVMRKVWLHQTRIGLSLYDVAGQGYLRESDLENYILELIPTLPQLDGLEKSFYSFYVCTAVRKFFFFLDPLRTGKIKIQDILACSFLDDLLELRDEELSKESQETNWFSAPSALRVYGQYLNLDKDHNGMLSKEELSRYGTATMTNVFLDRVFQECLTYDGEMDYKTYLDFVLALENRKEPAALQYIFKLLDIENKGYLNVFSLNYFFRAIQELMKIHGQDPVSFQDVKDEIFDMVKPKDPLKISLQDLINSNQGDTVTTILIDLNGFWTYENREALVANDSENSADLDDT

SEQ ID NO: 4898 - protein, 1115 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 4899 - protein, 642 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 4900 - protein, 1589 aa, Homo sapiens
MSLPFYQRCHQHYDLSYRNKDVRSTVSHYQREKKRSAVYTQGSTAYSSRSSAAHRRESEAFRRASASSSQQQASQHALSSEVSRKAASAYDYGSSHGLTDSSLLLDDYSSKLSPKPKRAKHSLLSGEEKENLPSDYMVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLRKTLEETETYHAKLNEDHLLHAPEFIIKPRSHTVWEKENVKLHCSIAGWPEPRVTWYKNQVPINVHANPGKYIIESRYGMHTLEINGCDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIQWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEPVAALDPAEKARLKSRPSAPWTGQIIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEASVAGSGKWEPCNNNPVKGSRFTCHGLVTGQSYIFRVRAVNAAGLSEYSQDSEAIEVKAAIAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 4901 - protein, 181 aa, Homo sapiens
MGGFFSSIFSSLFGTREMRILILGLDGAGKTTILYRLQVGEVVTTIPTIGFNVETVTYKNLKFQVWDLGGQTSIRPYWRCYYSNTDAVIYVVDSCDRDRIGISKSELVAMLEEEELRKAILVVFANKQDMEQAMTSSEMANSLGLPALKDRKWQIFKTSATKGTGLDEAMEWLVETLKSRQ

SEQ ID NO: 4902 - protein, 422 aa, Homo sapiens
MAAAAVVEFQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWKTAYSYFYEAFEGYDSIDSPKAITSLKYMLLCKIMLNTPEDVQALVSGKLALRYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYNKAKKLT

SEQ ID NO: 4903 - protein, 482 aa, Homo sapiens
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKGPDSHYGTKGLKKVVHETPAASKTVFFFFSSPGNNNGTSIEDGQIPEIIFYT

SEQ ID NO: 4904 - protein, 960 aa, Homo sapiens
MSRLIVKNLPNGMKEERFRQLFAAFGTLTDCSLKFTKDGKFRKFGFIGFKSEEEAQKAQKHFNKSFIDTSRITVEFCKSFGDPAKPRAWSKHAQKPSQPKQPPKDSTTPEIKKDEKKKKVAGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKAGSSSSSEEEESEDEAVHCDEGSEAEEEDSSATPVLQERDSKGAGQEQGMPAGKKRPPEARAETEKPANQKEPTTCHTVKLRGAPFNVTEKNVMEFLAPLKPVAIRIVRNAHGNKTGYIFVDFSNEEEVKQALKCNREYMGGRYIEVFREKNVPTTKGAPKNTTKSWQGRILGENEEEEDLAESGRLFVRNLPYTSTEEDLEKLFSKYGPLSELHYPIDSLTKKPKGFAFITFMFPEHAVKAYSEVDGQVFQGRMLHVLPSTIKKEASEDASALGSSSYKKKKEAQDKANSASSHNWNTLFMGPNAVADAIAQKYNATKSQVFDHETKGSVAVRVALGETQLVQEVRRFLIDNGVSLDSFSQAAAERSKTVILVKNLPAGTLAAQLQETFGHFGSLGRVLLPEGGITAIVEFLEPLEARKAFRHLAYSKFHHVPLYLEWAPVGVFSSTAPQKKKLQDTPSEPMEKDPAEPETVPDGETPEDENPTEEGADNSSAKMEEEEEEEEEEEESLPGCTLFIKNLNFDTTEEKLKEVFSKVGTVKSCSISKKKNKAGVLLSMGFGFVEYRKPEQAQKALKQLQGHVVDGHKLEVRISERATKPAVTLARKKQVPRKQTTSKILVRNIPFQAHSREIRELFSTFGELKTVRLPKKMTGTGTHRGFGFVDFLTKQDAKRAFNALCHSTHLYGRRLVLEWADSEVTLQALRRKTAAHFHEPPKKKRSVVLDEILEQLEGSDSDSEEQTLQL

SEQ ID NO: 4905 - protein, 972 aa, Homo sapiens
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVETISVILWVSSYCESVLRPYKLNLQKKKKKKKETSIIMPPVFTSFQDYVTGLQTLISNVVDHIKGLETHLIALKLEELILEDTSLSPEERKFSKTVQGKVQSSYLHSLLEMGELLKKRLETTKKLKI

SEQ ID NO: 4906 - protein, 721 aa, Homo sapiens
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPMDEPISSHPFHIEDEVDDILLMDETHSHIYNWERYHDCQFSEHDWPVHNNFDIDEVQLDPRALSDVTDEEEVQVDPRKYLDGDREKYLEDPAFDTNYSTEPCWQYSDHHENKYCDLECSHTCNYKTRSSSYLDNLVWRESEVNHYYEPKLIIDLSNWKEQSKEKSDKKGKSKCERNGLVKAQIALEEASQQLAGKEREKNQGFDFDSFIAGTIQLSSQHEPTDVVDKLNDLNSSVSQLELKSLISKSVSQEKQEKGMANLAQLEALYQSSWDSQFVSGGEDCFFINQFCEVRKDEQVEKENTYTSYLDKFFSRKEDTEMLETEPVEDGKLGERGHEEGFLNNSGEFLFNKQLESIGIPQFHSPVGSPLKSIQATLTPSAMKSSPQIPHQTYSSILKHLN

SEQ ID NO: 4907 - protein, 315 aa, Homo sapiens
MAAGVPCALVTSCSSVFSGDQLVQHILGTEDLIVEVTSNDAVRFYPWTIDNKYYSADINLCVVPNKFLVTAEIAESVQAFVVYFDSTQKSGLDSVSSWLPLAKAWLPEVMILVCDRVSEDGINRQKAQEWCIKHGFELVELSPEELPEEDDDFPESTGVKRIVQALNANVWSNVVMKNDRNQGFSLLNSLTGTNHSIGSADPCHPEQPHLPAADSTESLSDHRGGASNTTDAQVDSIVDPMLDLDIQELASLTTGGGDVENFERLFSKLKEMKDKAATLPHEQRKVHAEKVAKAFWMAIGGDRDEIEGLSSDEEH

SEQ ID NO: 4908 - protein, 445 aa, Homo sapiens
MAAPEERDLTQEQTEKLLQFQDLTGIESMDQCRHTLEQHNWNIEAAVQDRLNEQEGVPSVFNPPPSRPLQVNTADHRIYSYVVSRPQPRGLLGWGYYLIMLPFRFTYYTILDIFRFALRFIRPDPRSRVTDPVGDIVSFMHSFEEKYGRAHPVFYQGTYSQALNDAKRELRFLLVYLHGDDHQDSDEFCRNTLCAPEVISLINTRMLFWACSTNKPEGYRVSQALRENTYPFLAMIMLKDRRMTVVGRLEGLIQPDDLINQLTFIMDANQTYLVSERLEREERNQTQVLRQQQDEAYLASLRADQEKERKKREERERKRRKEEEVQQQKLAEERRRQNLQEEKERKLECLPPEPSPDDPESVKIIFKLPNDSRVERRFHFSQSLTVIHDFLFSLKESPEKFQIEANFPRRVLPCIPSEEWPNPPTLQEAGLSHTEVLFVQDLTDE

SEQ ID NO: 4909 - protein, 907 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 4910 - protein, 361 aa, Homo sapiens
MTGKAGEALSKPKSETVAKSTSGGAPARCTGFGIQEILGLNKEPPSSHPRAALDGLAPGHLLAARSVLSPAGVGGMGLLGPGGLPGFYTQPTFLEVLSDPQSVHLQPLGRASGPLDTSQTASSDSEDVSSSDRKMSKSALNQTKKRKKRRHRTIFTSYQLEELEKAFNEAHYPDVYAREMLAMKTELPEDRIQVWFQNRRAKWRKREKCWGRSSVMAEYGLYGAMVRHSIPLPESILKSAKDGIMDSCAPWLLGMHKKSLEAAAESGRKPEGERQALPKLDKMEQDERGPDAQAAISQEELRENSIAVLRAKAQEHSTKVLGTVSGPDSLARSTEKPEEEEAMDEDRPAERLSPPQLEDMA

SEQ ID NO: 4911 - protein, 690 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQASYLPKPGAQLYQFRYVNRQGQVCGQSPPFQFREPRPMDELVTLEEADGGSDILLVVPKATVLQNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 4912 - protein, 659 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 4913 - protein, 499 aa, Homo sapiens
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 4914 - protein, 161 aa, Homo sapiens
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVHLHVHSQTMAKSRNTSWSQCPGLTACSTREPQDGPTQVHPRWGL

SEQ ID NO: 4915 - protein, 506 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKVTALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 4916 - protein, 232 aa, Homo sapiens
MQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTAV

SEQ ID NO: 4917 - protein, 406 aa, Homo sapiens
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 4918 - protein, 1866 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 4919 - protein, 298 aa, Homo sapiens
MMNVNTRGTYLASKACIPYLKKSKVAHILNISPPLNLNPVWFKQHCAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 4920 - protein, 1341 aa, Homo sapiens
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 4921 - protein, 199 aa, Homo sapiens
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGEVCPAGWKPGSDTIKPDVQKSKEYFSKQK

SEQ ID NO: 4922 - protein, 358 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 4923 - protein, 531 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKILQAHGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 4924 - protein, 1983 aa, Homo sapiens
MSGNKRGSRASCPHRGAECLLPWAALNLQGFQLLLLHPSATAMMDVSELGESARYLRQGYQEMTKVHTIPWDGKKRVWVPDEQDAYVEAEVKSEATGGRVTVETKDQKVLMVREAELQPMNPPRFDLLEDMAMMTHLNEASVLHNLRQRYARWMIYTYSGLFCVTINPYKWLPVYTASVVAAYKGKRRSDSPPHIYAVADNAYNDMLRNRDNQSMLITGESGAGKTVNTKRVIQYFAIVAALGDGPGKKAQFLATKTGGTLEDQIIEANPAMEAFGNAKTLRNDNSSRFGKFIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLKLTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 4925 - protein, 909 aa, Homo sapiens
MERAMEQLNRLTRSLRRARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKTTVQCLLDSGADINRPNVSGATPLYFACSHGQRDTAQILLLRGAKYLPDKNGVTPLDLCVQGGYGETCEVLIQYHPRLFQTIIQMTQNEDLRENMLRQVLEHLSQQSESQYLKILTSLAEVATTNGHKLLSLSSNYDAQMKSLLRIVRMFCHVFRIGPSSPSNGIDMGYNGNKTPRSQVFKPLELLWHSLDEWLVLIATELMKNKRDSTEITSILLKQKGQDQDAASIPPFEPPGPGSYENLSTGTRESKPDALAGRQEASADCQDVISMTANRLSAVIQAFYMCCSCQMPPGMTSPRFIEFVCKHDEVLKCFVNRNPKIIFDHFHFLLECPELMSRFMHIIKAQPFKDRCEWFYEHLHSGQPDSDMVHRPVNENDILLVHRDSIFRSSCEVVSKANCAKLKQGIAVRFHGEEGMGQGVVREWFDILSNEIVNPDYALFTQSADGTTFQPNSNSYVNPDHLNYFRFAGQILGLALNHRQLVNIYFTRSFYKHILGIPVNYQDVASIDPEYAKNLQWILDNDISDLGLELTFSVETDVFGAMEEVPLKPGGGSILVTQNNKAEYVQLVTELRMTRAIQPQINAFLQGFHMFIPPSLIQLFDEYELELLLSGMPEIDVSDWIKNTEYTSGYEREDPVIQWFWEVVEDITQEERVLLLQFVTGSSRVPHGGFANIMGGSGLQNFTIAAVPYTPNLLPTSSTCINMLKLPEYPSKEILKDRLLVALHCGSYGYTMA

SEQ ID NO: 4926 - protein, 892 aa, Homo sapiens
MRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 4927 - protein, 510 aa, Homo sapiens
MAAELVEAKNMVMSFRVSDLQMLLGFVGRSKSGLKHELVTRALQLVQFDCSPELFKKIKELYETRYAKKNSEPAPQPHRPLDPLTMHSTYDRAGAVPRTPLAGPNIDYPVLYGKYLNGLGRLPAKTLKPEVRLVKLPFFNMLDELLKPTELVPQNNEKLQESPCIFALTPRQVELIRNSRELQPGVKAVQVVLRICYSDTSCPQEDQYPPNIAVKVNHSYCSVPGYYPSNKPGVEPKRPCRPINLTHLMYLSSATNRITVTWGNYGKSYSVALYLVRQLTSSELLQRLKTIGVKHPELCKALVKEKLRLDPDSEIATTGVRVSLICPLVKMRLSVPCRAETCAHLQCFDAVFYLQMNEKKPTWMCPVCDKPAPYDQLIIDGLLSKILSECEDADEIEYLVDGSWCPIRAEKERSCSPQGAILVLGPSDANGLLPAPSVNGSGALGSTGGGGPVGSMENGKPGADVVDLTLDSSSSSEDEEEEEEEEEDEDEEGPRPKRRCPFQKGLVPAC

SEQ ID NO: 4928 - protein, 227 aa, Homo sapiens
MAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 4929 - protein, 551 aa, Homo sapiens
MEEAELVKGRLQAITDKRKIQEEISQKRLKIEEDKLKHQHLKKKALREKWLLDGISSGKEQEEMKKQNQQDQHQIQVLEQSILRLEKEIQDLEKAELQISTKEEAILKKLKSIERTTEDIIRSVKVEREERAEESIEDIYANIPDLPKSYIPSRLRKEINEEKEDDEQNRKALYAMEIKVEKDLKTGESTVLSSIPLPSDDFKGTGIKVYDDGQKSVYAVSSNHSAAYNGTDGLAPVEVEELLRQASERNSKSPTEYHEPVYANPFYRPTTPQRETVTPGPNFQERIKIKTNGLGIGVNESIHNMGNGLSEERGNNFNHISPIPPVPHPRSVIQQAEEKLHTPQKRLMTPWEESNVMQDKDAPSPKPRLSPRETIFGKSEHQNSSPTCQEDEEDVRYNIVHSLPPDINDTEPVTMIFMGYQQAEDSEEDKKFLTGYDGIIHAELVVIDDEEEEDEGEAEKPSYHPIAPHSQVYQPAKPTPLPRKRSEASPHENTNHKSPHKNSISLKEQEESLGSPVHHSPFDAQTTGDGTEDPSLTALRMRMAKLGKKVI

SEQ ID NO: 4930 - protein, 566 aa, Homo sapiens
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 4931 - protein, 486 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 4932 - protein, 753 aa, Homo sapiens
MMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 4933 - protein, 531 aa, Homo sapiens
MRMHTRLSLPGPPHHVGAAYPPAGGNRSENAGSWGGAGASSVEPLARRVASGEATLAMDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQVSRLASEKRELEAQLGRSREEALAGRAARQEAEALRGLVRGLELELRQERGLGHRVAGRRGQDCRRLAKELEEAKASERSLRARLKTLTSELALYKRGGRGSRGRGRPARPSPSPTGGRALRFDPTAFVKAKERKQREIQMKQQQRNRLGSGGSGDGPSVSWSRQTQPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 4934 - protein, 483 aa, Homo sapiens
MASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 4935 - protein, 337 aa, Homo sapiens
MADAAPQLGKRKRELDVEEAHAASTEEKEAGVGNGTCAPVRLPFSGFRLQKVLRESARDKIIFLHGKVNEASGDGDGEDAVVILEKTPFQVEQVAQLLTGSPELQLQFSNDIYSTYHLFPPRQLNDVKTTVVYPATEKHLQKYLRQDLRLIRETGDDYRNITLPHLESQSLSIQWVYNILDKKAEADRIVFENPDPSDGFVLIPDLKWNQQQLDDLYLIAICHRRGIRSLRDLTPEHLPLLRNILHQGQEAILQRYRMKGDHLRVYLHYLPSYYHLHVHFTALGFEAPGSGVERAHLLAEVIENLECDPRHYQQRTLTFALRADDPLLKLLQEAQQS

SEQ ID NO: 4936 - protein, 593 aa, Homo sapiens
MKLQAVMETLLQRQQRARQELEARQQLPPDPPAAPPGRARAAPDEDREPESARMQRAQMAALAAMRAAAAGLGHPASPGGSEDGPPGSEEEDAAREGTPGSPGRGREGPGEEHFEDMASDEDMKPKWEEEEMEEDLGEDEEEEEEDYEDEEEEEDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKEEDSAIPITVPGRLPVSLAGHPVVAAQAAAVQAAAAQAAVAAQAAALEQLREKLESAEPPEKKMALVADEQQRLMQRALQQNFLAMAAQLPMSIRINSQASESRQDSAVNLTGTNGSNSISMSVEINGIMYTGVLFAQPPAPTPTSAPNKGGGGGGGSSSNAGGRGGNTGTSGGQAGPAGLSTPSTSTSNNSLP

SEQ ID NO: 4937 - protein, 2063 aa, Homo sapiens
MADGAPRPQLYRSVSFKLLERWSGGPGLREEDTDTPGLRRRASCRPTTAARGQPSRRVSKLASGPLAAPAQPRPLRSLSPSVRQLSRRFDAPRLDDGSAGTRDGGVLPAAAEEAAEGPARGAWPSVTEMRKLFGGPGSRRPSADSESPGTPSPDGAAWEPPARESRQPPTPPPRTCFPLAGLRSARPLTGPETEGRLRRPQQQQERAQRPADGLHSWHIFSQPQAGARASCSSSSIAASYPVSRSRAASSSEEEEEGPPQLPGAQSPAYHGGHSSGSDDDRDGEGGHRWGGRPGLRPGSSLLDQDCRPDSDGLNLSSMNSAGVSGSPEPPTSPRAPREEGLREWGSGSPPCVPGPQEGLRPMSDSVGGAFRVAKVSFPSYLASPAGSRGSSRYSSTETLKDDDLWSSRGSGGWGVYRSPSFGAGEGLLRSQARTRAKGPGGTSRALRDGGFEPEKSRQRKSLSNPDIASETLTLLSFLRSDLSELRVRKPGGSSGDRGSNPLDGRDSPSAGGPVGQLEPIPIPAPASPGTRPTLKDLTATLRRAKSFTCSEKPMARRLPRTSALKSSSSELLLTGPGAEEDPLPLIVQDQYVQEARQVFEKIQRMGAQQDDGSDAPPGSPDWAGDVTRGQRSQEELSGPESSLTDEGIGADPEPPVAAFCGLGTTGMWRPLSSSSAQTNHHGPGTEDSLGGWALVSPETPPTPGALRRRRKVPPSGSGGSELSNGEAGEAYRSLSDPIPQRHRAATSEEPTGFSVDSNLLGSLSPKTGLPATSAMDEGLTSGHSDWSVGSEESKGYQEVIQSIVQGPGTLGRVVDDRIAGKAPKKKSLSDPSRRGELAGPGFEGPGGEPIREVEPMLPPSSSEPILVEQRAEPEEPGATRSRAQSERALPEALPPPATAHRNFHLDPKLADILSPRLIRRGSKKRPARSSHQELRRDEGSQDQTGSLSRARPSSRHVRHASVPATFMPIVVPEPPTSVGPPVAVPEPIGFPTRAHPTLQAPSLEDVTKQYMLNLHSGEVPAPVPVDMPCLPLAAPPSAEAKPPEAARPADEPTPASKCCSKPQVDMRKHVAMTLLDTEQSYVESLRTLMQGYMQPLKQPENSVLCDPSLVDEIFDQIPELLEHHEQFLEQVRHCMQTWHAQQKVGALLVQSFSKDVLVNIYSAYIDNFLNAKDAVRVAKEARPAFLKFLEQSMRENKEKQALSDLMIKPVQRIPRYELLVKDLLKHTPEDHPDHPLLLEAQRNIKQVAERINKGVRSAEEAERHARVLQEIEAHIEGMEDLQAPLRRFLRQEMVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 4938 - protein, 832 aa, Homo sapiens
MSEAGGAGPGGCGAGAGAGAGPGALPPQPAALPPAPPQGSPCAAAAGGSGACGPATAVAAAGTAEGPGGGGSARIAVKKAQLRSAPRAKKLEKLGVYSACKAEESCKCNGWKNPNPSPTPPRADLQQIIVSLTESCRSCSHALAAHVSHLENVSEEEMNRLLGIVLDVEYLFTCVHKEEDADTKQVYFYLFKLLRKSILQRGKPVVEGSLEKKPPFEKPSIEQGVNNFVQYKFSHLPAKERQTIVELAKMFLNRINYWHLEAPSQRRLRSPNDDISGYKENYTRWLCYCNVPQFCDSLPRYETTQVFGRTLLRSVFTVMRRQLLEQARQEKDKLPLEKRTLILTHFPKFLSMLEEEVYSQNSPIWDQDFLSASSRTSQLGIQTVINPPPVAGTISYNSTSSSLEQPNAGSSSPACKASSGLEANPGEKRKMTDSHVLEEAKKPRVMGDIPMELINEVMSTITDPAAMLGPETNFLSAHSARDEAARLEERRGVIEFHVVGNSLNQKPNKKILMWLVGLQNVFSHQLPRMPKEYITRLVFDPKHKTLALIKDGRVIGGICFRMFPSQGFTEIVFCAVTSNEQVKGYGTHLMNHLKEYHIKHDILNFLTYADEYAIGYFKKQGFSKEIKIPKTKYVGYIKDYEGATLMGCELNPRIPYTEFSVIIKKQKEIIKKLIERKQAQIRKVYPGLSCFKDGVRQIPIESIPGIRETGWKPSGKEKSKEPRDPDQLYSTLKSILQQVKSHQSAWPFMEPVKRTEAPGYYEVIRFPMDLKTMSERLKNRYYVSKKLFMADLQRVFTNCKEYNPPESEYYKCANILEKFFFSKIKEAGLIDK

SEQ ID NO: 4939 - protein, 1649 aa, Homo sapiens
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 4940 - protein, 1883 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 4941 - protein, 195 aa, Homo sapiens
MAEPVQEELSVLAAIFCRPHEWEVLSRSETDGTVFRIHTKAEGFMDVDIPLELVFHLPVNYPSCLPGISINSEQLTRAQCVTVKENLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPKS

SEQ ID NO: 4942 - protein, 372 aa, Homo sapiens
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 4943 - protein, 309 aa, Homo sapiens
MEAARTAVLRVKRKRSAEPAEALVLACKRLRSDAVESAAQKTSEGLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVNDDQEPEDIYDDEDDENSENNWRNEYPEEESSDGDEDSRGSADYNSLSEEERGSSRQRMWSKYPLDVQKEFGYDSPHDLDSD

SEQ ID NO: 4944 - protein, 355 aa, Homo sapiens
MADNSSDECEEENNKVLREGMPQAPGHRGKDMDPVPPAPASLKCHQTPSHVLERVGWYRESQKHRKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 4945 - protein, 304 aa, Homo sapiens
MADNSSDECEEENNKEKKKTSQLTPQRGFSENEDDDDDDDDSSETDSDSDDDDEEHGAPLEGAYDPADYEHLPVSAEIKELFQYISRYTPQLIDLDHKLKPFIPDFIPAVGDIDAFLKVPRPDGKPDNLGLLVLDEPSTKQSDPTVLSLWLTENSKQHNITQHMKVKSLEDAEKNPKAIDTWIESISELHRSKPPATVHYTRPMPDIDTLMQEWSPEFEELLGKVSLPTAEIDCSLAEYIDMICAILDIPVYKSRIQSLHLLFSLYSEFKNSQHFKALAEGKKAFTPSSNSTSQAGDMETLTFS

SEQ ID NO: 4946 - protein, 444 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 4947 - protein, 465 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 4948 - protein, 1585 aa, Homo sapiens
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 4949 - protein, 125 aa, Homo sapiens [sequence omitted]

SEQ ID NO: 4950 - protein, 529 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 4951 - protein, 245 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 4952 - protein, 581 aa, Homo sapiens [sequence omitted]

SEQ ID NO: 4953 - protein, 1050 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 4954 - protein, 1022 aa, Homo sapiens
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHTTGQVVSFGHGPSDTSKPTHPEALTENFDISCLISAEDFVDVQVKHIFAGTYANFVTTHQDTSSTRAPGKTLPEISRISQSMAEKWIAVKRRSTEHEMAKSEIRMIFSSPACLTASFLKKRGTGETTSIDVDLEMARDTFKKLTKKEWISSMITTCLEDDLLRALPCHSPHQEALSVFLLLPECPVMHDSKNWKNLVVPFAKAVCEMSKQSLQVLKKCWAFLQESSLNPLIQMLKAAIISQLLHQTKTEQDHCNVKALLGMMKELHKVNKANCRLPENTFNINELSNLLNFYIDRGRQLFRDNHLIPAETPSPVIFSDFPFIFNSLSKIKLLQADSHIKMQMSEKKAYMLMHETILQKKDEFPPSPRFILRVRRSRLVKDALRQLSQAEATDFCKVLVVEFINEICPESGGVSSEFFHCMFEEMTKPEYGMFMYPEMGSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 4955 - protein, 406 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 4956 - protein, 525 aa, Homo sapiens
MAAGLLGSEDPPWSWNLTCRALRTCQVRNIRVLQLLLKPWCISRAVYQMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKL

SEQ ID NO: 4957 - protein, 534 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 4958 - protein, 436 aa, Homo sapiens
MRRDVNGVTKSRFEMFSNSDEAVINKKLPKELLLRIFSFLDVVTLCRCAQVSRAWNVLALDGSNWQRIDLFDFQRDIEGRVVENISKRCGGFLRKLSLRGCLGVGDNALRTFAQNCRNIEVLNLNGCTKTTDATCTSLSKFCSKLRHLDLASCTSITNMSLKALSEGCPLLEQLNISWCDQVTKDGIQALVRGCGGLKALFLKGCTQLEDEALKYIGAHCPELVTLNLQTCLQITDEGLITICRGCHKLQSLCASGCSNITDAILNALGQNCPRLRILEVARCSQLTDVGFTTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRTHLPNIKVHAYFAPVTPPPSVGGSRQRFCRCCIIL

SEQ ID NO: 4959 - protein, 388 aa, Homo sapiens
MRCLYGRVGGARRKMAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 4960 - protein, 555 aa, Homo sapiens
MRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLAVHPEQLPPRPWITLKERDQILPSASFTVMCYNVLCDKYATRQLYGYCPSWALNWEYRKKGIMEEIVNCDADIISLQEVETEQYFTLFLPALKERGYDGFFSPKSRAKIMSEQERKHVDGCAIFFKTEKFTLVQKHTVEFNQVAMANSDGSEAMLNRVMTKDNIGVAVVLEVHKELFGAGMKPIHAADKQLLIVANAHMHWDPEYSDVKLIQTMMFVSEVKNILEKASSRPGSPTADPNSIPLVLCADLNSLPDSGVVEYLSNGGVADNHKDFKELRYNECLMNFSCNGKNGSSEGRITHGFQLKSAYENNLMPYTNYTFDFKGVIDYIFYSKTHMNVLGVLGPLDPQWLVENNITGCPHPHIPSDHFSLLTQLELHPPLLPLVNGVHLPNRR

SEQ ID NO: 4961 - protein, 890 aa, Homo sapiens
SSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI

SEQ ID NO: 4962 - protein, 647 aa, Homo sapiens
MARAGPRLVLSEEAVRAKSGLGPHRDLAELQSLSIPGTYQEKITHLGHSLMSLTGLKSLDLSRNSLVSLEGIQYLTALESLNLYYNCISSLAEVFRLHALTELVDVDFRLNPVVKVEPDYRLFVVHLLPKLQQLDDRPVRASERKASRLHFASEDSLDSKESVPASLKEGRPHHPRAKCTEALAKQSLVMDADDEAVLNLIAECEWDLGRPPGSTSFSQKGREADSRGSQESRHLLSPQLVQYQCGDSGKQGRETRRSSCRGCCLEKMPWSQLCGELPPLYGAEPEASRAPRPHTYFTPHPDSMDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQAALLETLLDLVDRSWGGCRSLHSNEAFLAQARHILSSVEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCGEIVELKQHLEHYDKIQELTQMLQESHSSLVSTNEHLLQELSQVRAQHRAEVEQMHWSYQELKKTMALFPHSSASHGGCQAC

SEQ ID NO: 4963 - protein, 258 aa, Homo sapiens
MAETEERSLDNFFAKRDKKKKKERSNRAASAAGAAGSAGGSSGAAGAAGGGAGAGTRPGDGGTASAGAAGPGAATKAVTKDEDEWKELEQKEVDYSGLRVQAMQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKDKEMEKSFEVVRHKNRGRDEVSKNQALKLQLDNQYAVLENQKSSHSQYN

SEQ ID NO: 4964 - protein, 358 aa, Homo sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 4965 - protein, 207 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 4966 - protein, 1074 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSVATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 4967 - protein, 145 aa, Homo sapiens
MKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEELIEKMQE

SEQ ID NO: 4968 - protein, 1058 aa, Homo sapiens
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRVLEAGKANVILPKSSPSGITHVIASNARIKAEKEKDNFKAPFYPIQYLGDFLLEKEIQNDEDSQTNSVWTEHSNEETNKDFRKDAGFLEMKGALRETMYRTQKEMQNHEDVNVGSILIQHHKKEKFSGSSKDLKFVKMRNTFGSHTYENQKEIKKKDEDIQRSYTLRRKRKKGKESNCKKGVEHEKIKSTLRRHIYNRDQKEMKNSIFAEYAKESKAMAIKTDVDVVEIKNTLRKHIYRAQAVRYNCIRIDKQPVYNVEVKNAEFPRGVLNLIESLIEGHFFKEAIEELSTLQAHYIPPVCVLHALLENVLQDNIDTFSGRYFHILSALLHLHPPWKSPAMSRYYLELFQCPTCMKGAWSLVEVLIRSCLFNESFCHQISENIGSKVLHLTLLKFFFNLIESEVQHLSQKLYDWSDSQNLKITGKAMLLEIFWSGSETSGLLTKPVNMLLEWTIYSHKEKFKSNDVFKHELAYLLAGILGAAIDYWIFLGLKMGRNVMRHMSDDLGSYVSLSCDDFSSQELEIFICSFSSSWLQMFVAEAVFKKLCLQSSGSVSSEPLSLQKMVYSYLPALGKTGVLGSGKIQVSKKIGQRPCFDSQRTLLMLNGTKQKQVEGLPELLDLNLAKCSSSLKKLKKKSEGELSCSKENCPSVVKKMNFHKTNLKGETALHRACINNQVEKLILLLSLPGIDINVKDNAGWTPLHEACNYGNTVCVQEILQRCPEVDLLTQVDGVTPLHDALSNGHVEIGKLLLQHGGPVLLQQRNAKGELPLDYVVSPQIKEELFAITKIEDTVENFHAQAEKHFHYQQLEFGSFLLSRMLLNFCSIFDLSSEFILASKGLTHLNELLMACKSHKETTSVHTDWLLDLYAGNIKTLQKLPHILKELPENLKVCPGVHTEALMITLEMMCRSVMEFS

SEQ ID NO: 4969 - protein, 219 aa, Homo sapiens
MEPKEATGKENMVTKKKNLAFLRSRLYMLERRKTDTVVESSVSGDHSGTLRRSQSDRTEYNQKLQEKMTPQGECSVAETLTPEEEHHMKRMMAKREKIIKELIQTEKDYLNDLELCVREVVQPLRNKKTDRLDVDSLFSNIESVHQISAKLLSLLEEATTDVEPAMQVIGEVFLQIKGPLEDIYKIYCYHHDEAHSILESYEKEEELKEHLSHCIQSLK

SEQ ID NO: 4970 - protein, 1060 aa, Homo sapiens
MLIEDVDALKSWLAKLLEPICDADPSALANYVVALVKKDKPEKELKAFCADQLDVFLQKETSGFVDKLFESLYTKNYLPLLEPVKPEPKPLVQEKEEIKEEVFQEPAEEERDGRKKKYPSPQKTRSESSERRTREKKREDGKWRDYDRYYERNELYREKYDWRRGRSKSRSKSRGLSRSRSRSRGRSKDRDPNRNVEHRERSKFKSERNDLESSYVPVSAPPPNSSEQYSSGAQSIPSTVTVIAPAHHSENTTESWSNYYNNHSSSNSFGRNLPPKRRCRDYDERGFCVLGDLCQFDHGNDPLVVDEVALPSMIPFPPPPPGLPPPPPPGMLMPPMPGPGPGPGPGPGPGPGPGPGPGHSMRLPVPQGHGQPPPSVVLPIPRPPITQSSLINSRDQPGTSAVPNLASVGTRLPPPLPQNLLYTVSERQPMYSREHGAAASERLQLGTPPPLLAARLVPPRNLMGSSIGYHTSVSSPTPLVPDTYEPDGYNPEAPSITSSGRSQYRQFFSRTQTQRPNLIGLTSGDMDVNPRAANIVIQTEPPVPVSINSNITRVVLEPDSRKRAMSGLEGPLTKKPWLGKQGNNNQNKPGFLRKNQYTNTKLEVKKIPQELNNITKLNEHFSKFGTIVNIQVAFKGDPEAALIQYLTNEEARKAISSTEAVLNNRFIRVLWHRENNEQPTLQSSAQLLLQQQQTLSHLSQQHHHLPQHLHQQQVLVAQSAPSTVHGGIQKMMSKPQTSGAYVLNKVPVKHRLGHAGGNQSDASHLLNQSGGAGEDCQIFSTPGHPKMIYSSSNLKTPSKLCSGSKSHDVQEVLKKKQEAMKLQQDMRKKRQEVLEKQIECQKMLISKLEKNKNMKPEERANIMKTLKELGEKISQLKDELKTSSAVSTPSKVKTKTEAQKELLDTELDLHKRLSSGEDTTELRKKLSQLQVEAARLGILPVGRGKTMSSQGRGRGRGRGGRGRGSLNHMVVDHRPKALTVGGFIEEEKEDLLQHFSTANQGPKFKDRRLQISWHKPKVPSISTETEEEEVKEEETETSDLFLPDDDDEDEDEYESRSWRR

SEQ ID NO: 4971 - protein, 605 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKARVANQDLQVQLDQALQQALDPNSKGNSLFAEVEDRRAAMERQLISMKVKYQSLKKQNVFNREQMQRMKLQIATLLQMKGSQTEFEQQERLLAMLEQKNGEIKHLLGEIRNLEKFKNLYDSMESKPSVDSGTLEDNTYYTDLLQMKLDNLNKEIESTKGELSIQRMKALFESQRALDIERKLFANERCLQLSESENMKLRAKLDELKLKYEPEETVEVPVLKKRREVLPVDITTAKDACVNNSALGGEVYRLPPQKEETQSCPNSLEDNNLQLEKSVSIYTPVVSLSPHKNLPVDMQLKKEKKCVKLIGVPADAEALSERSGNTPNSPRLAAESKLQTEVKEGKETSSKLEKETCKKLHPILYVSSKSTPETQCPQQ

SEQ ID NO: 4972 - protein, 295 aa, Homo sapiens
MMAKKPPKPAPRRIFQERLKITALPLYFEGFLLIKRSGYREYEHYWTELRGTTLFFYTDKKSIIYVDKLDIVDLTCLTEQNSTEKNCAKFTLVLPKEEVQLKTENTESGEEWRGFILTVTELSVPQNVSLLPGQVIKLHEVLEREKKRRIETEQSTSVEKEKEPTEDYVDVLNPMPACFYTVSRKEATEMLQKNPSLGNMILRPGSDSRNYSITIRQEIDIPRIKHYKVMSVGQNYTIELEKPVTLPNLFSVIDYFVKETRGNLRPFICSTDENTGQEPSMEGRSEKLKKNPHIA

SEQ ID NO: 4973 - protein, 1606 aa, Homo sapiens
MFHICPAENLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPADDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 4974 - protein, 790 aa, Homo sapiens
MGTRKKVHAFVRVKPTDDFAHEMIRYGDDKRSIDIHLKKDIRRGVVNNQQTDWSFKLDGVLHDASQDLVYETVAKDVVSQALDGYNGTIMCYGQTGAGKTYTMMGATENYKHRGILPRALQQVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLSSLARKEGASSPVNGKDLDYVSTSKTQLVPSSKDGDVKDMLSRDRETSSIEPLPSDSPKEELRPIRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMEFDIWYNESFVIPEDMQMALKPGGSIRPGMVPVNRIVSLGEDDQDKFSQLQQRVLPEGPDSISFYNAKVKIEQKHNYLKTMMGLQQAHRK

SEQ ID NO: 4975 - protein, 291 aa, Homo sapiens [sequence omitted]

SEQ ID NO: 4976 - protein, 793 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 4977 - protein, 1124 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 4978 - protein, 454 aa, Homo sapiens
MLKQILSEMYIDPDLLAELSEEQKQILFFKMREEQIRRWKEREAAMERKESLPVKPRPKKENGKSVHWKLGADKEVWVWVMGEHHLDKPYDVLCNEIIAERARLKAEQEAEEPRKTHSEEFTNSLKTKSQYHDLQAPDNQQTKDIWKKVAEKEELEQGSRPAPTLEEEKIRSLSSSSRNIQQMLADSINRMKAYAFHQKKESMKKKQDEEINQIEEERTKQICKSWKEDSEWQASLRKSKAADEKRRSLAKQAREDYKRLSLGAQKGRGGERLQSPLRVPQKPERPPLPPKPQFLNSGAYPQKPLRNQGVVRTLSSSAQEDIIRWFKEEQLPLRAGYQKTSDTIAPWFHGILTLKKANELLLSTGMPGSFLIRVSERIKGYALSYLSEDGCKHFLIDASADAYSFLGVDQLQHATLADLVEYHKEEPITSLGKELLLYPCGQQDQLPDYLELFE

SEQ ID NO: 4979 - protein, 498 aa, Homo sapiens
MDETEWIHRHPKAEDLRVGLISWAGTYLTFEACKNTVTATAKSLGRRQTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQAQGGSFWSITSFGTFRPWGKFALNFCIELQGSNLLTVLAPNGFYMRADQSGTLLADSEDITRECIWEF

SEQ ID NO: 4980 - protein, 458 aa, Homo sapiens [sequence omitted]

SEQ ID NO: 4981 - protein, 986 aa, Homo sapiens
MERMNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGGPSRETGRREDITGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 4982 - protein, 2240 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGLESPRPNIILGLVICQKIKRPANSGELDKMDEKRTRLQPEEADVPAYPKVATVPQSEKKPSKYPLCSADAAVSTTPPGSPPPPPPLPEPPVLKVLSSLKPAAPSPATAATTAAAASTAASSTASSASKTASPLEHILQTLFGKKKSFDPSAREPPGSTAGLPQEPKTTAEDGVPAPPLLDPIVQQFGQFSKDKALEEEEDDRPYDPEEEYDPERAFDTQLVERGRRHEVERAPEAAAAEREEVAYDPEDETILEEAKVTVDDLPNRMCADVRRNSVERPAEPVAGAATPSLVEQQKMLEELNKQIEEQKRQLEEQEEALRQQRAAVGVSMAHFSVSDALMSPPPKSSLPKAELFQQEQQSADKPASLPPASQASNHRDPRQARRLATETGEGEGEPLSRLSARGAQGALPERDASRGGLVGQAPMPVPEEKEPASSPWASGEKPPAGSEQDGWKAEPGEGTRPATVGDSSARPARRVLLPTPPCGALQPGFPLQHDGERDPFTCPGFASQDKALGSAQYEDPRNLHSAGRSSSPAGETEGDREPQARPGEGTAPLPPPGQKVGGSQPPFQGQREPGPHALGMSGLHGPNFPGPRGPAPPFPEENIASNDGPRGPPPARFGAQKGPIPSLFSGQHGPPPYGDSRGPSPSYLGGPRGVAPSQFEERKDPHGEKREFQDAPYNEVTGAPAQFEGTEQAPFLGSRGGAPFQFGGQRRPLLSQLKGPRGGPPPSQFGGQRGPPPGHFVGPRGPHPSQFETARGPHPNQFEGPRGQAPNFMPGPRGIQPQQFEDQRVHSPPRFTNQRAPAPLQFGGLRGSAPFSEKNEQTPSRFHFQGQAPQVMKPGPRPLLELPSHPPQHRKDRWEEAGPPSALSSSAPGQGPEADGQWASADFREGKGHEYRNQTFEGRQRERFDVGPKEKPLEEPDAQGRASEDRRRERERGRNWSRERDWDRPREWDRHRDKDSSRDWDRNRERSANRDREREADRGKEWDRSRERSRNRERERDRRRDRDRSRSRERDRDKARDRERGRDRKDRSKSKESARDPKPEASRASDAGTASQA

SEQ ID NO: 4983 - protein, 544 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKCSGKYSYSLHPSLIA

SEQ ID NO: 4984 - protein, 387 aa, Homo sapiens
MERPPPRAAGRDPSALRAEAPWLRAEGPGPRAAPVTVPTPPQGSSVGGGFAGLEFARPQESEPRASDLGAPRTWTGAAAGPRTPSAHIPVPAQRATPGKARLDEVMAAAALTSLSTSPLLLGAPVAAFSPEPGLEPWKEALVRPPGSYSSSSNSGDWGWDLASDQSSPSTPSPPLPPEAAHFLFGEPTLRKRKSPAQVMFQCLWKSCGKVLSTASAMQRHIRLVHLGRQAEPEQSDGEEDFYYTELDVGVDTLTDGLSSLTPVSPTASMPPAFPRLELPELLEPPALPSPLRPPAPPLPPPPVLSTVANPQSCHSDRVYQGCLTPARLEPQPTEVGACPPALSSRIGVTLRKPRGDAKKCRKVYGMERRDLWCTACRWKKACQRFLD

SEQ ID NO: 4985 - protein, 137 aa, Homo sapiens
MLRFCAGLSDFAPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 4986 - protein, 834 aa, Homo sapiens
MRLLDGKQTSRYSENACEKKIFSIYGHYPVVRAALRRKGWVEKKFHFLPKVIPDVEDEGARVNDDTCAKVKENQEMALEKTDNIHDVMSRLVKNEMPYLLWTIKRDIIDYHSLTYDQMLNHYAKTASFTTKIGLCVNMRSLPWYVPANPDSFFPRCYSLCTESEQQEFLEDFRRTMASSILKWVVSHQSCSRSSRSKPRDQREEAGSSDLSSRQDAENAEAKLRGLPGQLVDIACKVCQAYLGQLEHEDIDTSADAVEDLTEAEWEDLTQQYYSLVQVPLGSSIVLCIFKIQKVMMSFEPPTARDRQCQALLNRITSVNPQTDIDGLRNIWIIKPAAKSRGRGESPDIVCMDRVEEILELAAADHPLSRDNKWVVQKYIETPLLICDTKFDIRQWFLVTDWNPLTIWFYKESYLRFSTQRFSLDKLDSAIHLCNNAVQKYLKNDVGRSPLLPAHNMWTSTRFQEYLQRQGRGAVWGSVIYPSMKKAIAHAMKVAQDHVEPRKNSFELYGADFVLGRDFRPWLIEINSSPTMHPSTPVTAQLCAQVQEDTIKVAVDRSCDIGNFELLWRQPVVEPPPFSGSDLCVAGVSVRRARRQVLPVCNLKASASLLDAQPLKARGPSAMPDPAQGPPSPALQRDLGLKEEKGLPLALLAPLRGAAESGGAAQPTRTKAAGKVELPACPCRHVDSQAPNTGVPVAQPAKSWDPNQLNAHPLEPVLRGLKTAEGALRPPPGGKGEGTVCSRLPHHGHHVAACQTTGTTWDGGPGVCFLRQLLASELPMGPGLPRDPRAPPCLVCRGLLPPAGPCKRCRSFCAAVLQGASFVRLGGRSCSPRTP

SEQ ID NO: 4987 - protein, 252 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKDTAFIPIPLVDTSIQGFPQDGLMACI

SEQ ID NO: 4988 - protein, 86 aa, Homo sapiens
MSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 4989 - protein, 426 aa, Homo sapiens
MASGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKGKTATEAADDIINNHLPKLKELGRNGEIHVDNIDVFCEKGVFDLDSTRRILQRGKDIGLQINFHGDELHPMKAAELGAELGAQAISHLEEVSDEGIVAMATARCSAILLPTTAYMLRLKQPRARKMLDEGVIVALGSDFNPNAYCFSMPMVMHLACVNMRMSMPEALAAATINAAYALGKSHTHGSLEVGKQGDLIIINSSRWEHLIYQFGGHHELIEYVIAKGKLIYKT

SEQ ID NO: 4990 - protein, 420 aa, Homo sapiens
MFSPGQEEHCAPNKEPVKYGELVVLGYNGALPNGDRGRRKSRFALYKRPKANGVKPSTVHVISTPQASKAISCKGQHSISYTLSRNQTVVVEYTHDKDTDMFQVGRSTESPIDFVVTDTISGSQNTDEAQITQSTISRFACRIVCDRNEPYTARIFAAGFDSSKNIFLGEKAAKWKNPDGHMDGLTTNGVLVMHPRGGFTEESQPGVWREISVCGDVYTLRETRSAQQRGKLVESETNVLQDGSLIDLCGATLLWRTADGLFHTPTQKHIEALRQEINAARPQCPVGLNTLAFPSINRKEVVEEKQPWAYLSCGHVHGYHNWGHRSDTEANERECPMCRTVGPYVPLWLGCEAGFYVDAGPPTHAFTPCGHVCSEKSAKYWSQIPLPHGTHAFHAACPFCATQLVGEQNCIKLIFQGPID

SEQ ID NO: 4991 - protein, 351 aa, Homo sapiens
MIVQRVVLNSRPGKNGNPVAENFRMEEVYLPDNINEGQVQVRTLYLSVDPYMRCRMNEDTGTDYITPWQLSQVVDGGGIGIIEESKHTNLTKGDFVTSFYWPWQTKVILDGNSLEKVDPQLVDGHLSYFLGAIGMPGLTSLIGIQEKGHITAGSNKTMVVSGAAGACGSVAGQIGHFLGCSRVVGICGTHEKCILLTSELGFDAAINYKKDNVAEQLRESCPAGVDVYFDNVGGNISDTVISQMNENSHIILCGQISQYNKDVPYPPPLSPAIEAIQKERNITRERFLVLNYKDKFEPGILQLSQWFKEGKLKIKETVINGLENMGAAFQSMMTGGNIGKQIVCISEEISL

SEQ ID NO: 4992 - protein, 723 aa, Homo sapiens
MAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISREDLLMRLLECDVIIYNITESSQQMEEAIWAVSALSEEVSHFEKRKLFILLSTVMTWARSKALDPEDSEVPFTEEDYRRRKSHPNFLDHINAEKMVLKFGKKARKFAAYVVAAGLQYGAEGGMLHTFFKMAWLGEIPALPVFGDGTNVIPTIHVLDLAGVIQNVIDHVPKPHYLVAVDESVHTLEDIVKCISKNTGPGKIQKIPRENAYLTKDLTQDCLDHLLVNLRMEALFVKENFNIRWAAQTGFVENINTILKEYKQSRGLMPIKICILGPPAVGKSSIAKELANYYKLHHIQLKDVISEAIAKLEAIVAPNDVGEGEEEVEEEEEEENVEDAQELLDGIKESMEQNAGQLDDQYIIRFMKEKLKSMPCRNQGYILDGFPKTYDQAKDLFNQEDEEEEDDVRGRMFPFDKLIIPEFVCALDASDEFLKERVINLPESIVAGTHYSQDRFLRALSNYRDINIDDETVFNYFDELEIHPIHIDVGKLEDAQNRLAIKQLIKEIGEPRNYGLTDEEKAEEERKAAEERLAREAAEEAEREHQEAVEMAEKIARWEEWNKRLEEVKREERELLEAQSIPLRNYLMTYVMPTLIQGLNECCNVRPEDPVDFLAEYLFKNNPEAQ

SEQ ID NO: 4993 - protein, 414 aa, Homo sapiens
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 4994 - protein, 199 aa, Homo sapiens
MRFRFCGDLDCPDWVLAEISTLAKMSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRMNRLAGVGWRVDYTLSSSLLQSVEEPMVHLRLEVAAAPGTPAQPVAMSLSADKFQVLLAELKQAQTLMSSLG

SEQ ID NO: 4995 - protein, 407 aa, Homo sapiens
MSHRKFSAPRHGHLGFLPHKRSHRHRGKVKTWPRDDPSQPVHLTAFLGYKAGMTHTLREVHRPGLKISKREEVEAVTIVETPPLVVVGVVGYVATPRGLRSFKTIFAEHLSDECRRRFYKDWHKSKKKAFTKACKRWRDTDGKKQLQKDFAAMKKYCKVIRVIVHTQMKLLPFRQKKAHIMEIQLNGGTVAEKVAWAQARLEKQVPVHSVFSQSEVIDVIAVTKGRGVKGVTSRWHTKKLPRKTHKGLRKVACIGAWHPARVGCSIARAGQKGYHHRTELNKKIFRIGRGPHMEDGKLVKNNASTSYDVTAKSITPLGGFPHYGEVNNDFVMLKGCIAGTKKRVITLRKSLLVHHSRQAVENIELKFIDTTSKFGHGRFQTAQEKRAFMGPQKKHLEKETPETSGDL

SEQ ID NO: 4996 - protein, 2440 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 4997 - protein, 770 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 4998 - protein, 931 aa, Homo sapiens
MAEVEAVQLKEEGNRHFQLQDYKAATNSYSQALKLTKDKALLATLYRNRAACGLKTESYVQAASDASRAIDINSSDIKALYRRCQALEHLGKLDQAFKDVQRCATLEPRNQNFQEMLRRLNTSIQEKLRVQFSTDSRVQKMFEILLDENSEADKREKAANNLIVLGREEAGAEKIFQNNGVALLLQLLDTKKPELVLAAVRTLSGMCSGHQARATVILHAVRIDRICSLMAVENEEMSLAVCNLLQAIIDSLSGEDKREHRGKEEALVLDTKKDLKQITSHLLDMLVSKKVSGQGRDQALNLLNKNVPRKDLAIHDNSRTIYVVDNGLRKILKVVGQVPDLPSCLPLTDNTRMLASILINKLYDDLRCDPERDHFRKICEEYITGKFDPQDMDKNLNAIQTVSGILQGPFDLGNQLLGLKGVMEMMVALCGSERETDQLVAVEALIHASTKLSRATFIITNGVSLLKQIYKTTKNEKIKIRTLVGLCKLGSAGGTDYGLRQFAEGSTEKLAKQCRKWLCNMSIDTRTRRWAVEGLAYLTLDADVKDDFVQDVPALQAMFELAKAGTSDKTILYSVATTLVNCTNSYDVKEVIPELVQLAKFSKQHVPEEHPKDKKDFIDMRVKRLLKAGVISALACMVKADSAILTDQTKELLARVFLALCDNPKDRGTIVAQGGGKALIPLALEGTDVGKVKAAHALAKIAAVSNPDIAFPGERVYEVVRPLVRLLDTQRDGLQNYEALLGLTNLSGRSDKLRQKIFKERALPDIENYMFENHDQLRQAATECMCNMVLHKEVQERFLADGNDRLKLVVLLCGEDDDKVQNAAAGALAMLTAAHKKLCLKMTQVTTQWLEILQRLCLHDQLSVQHRGLVIAYNLLAADAELAKKLVESELLEILTVVGKQEPDEKKAEVVQTARECLIKCMDYGFIKPVS

SEQ ID NO: 4999 - protein, 673 aa, Homo sapiens
MASQFCLPESPCLSPLKPLKPHFGDIQEGIYVAIQRSDKRIHLAVVTEINRENYWVTVEWVEKAVKKGKKIDLETILLLNPALDSAEHPMPPPPLSPLALAPSSAIRDQRTATKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDLDIITVPSDNVVMVHESKQKVDLTRYLQNQTFCFDHAFDDKASNELVYQFTAQPLVESIFRKGMATCFAYGQTGSGKTYTMGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTPVNAHSSRSHAVFQIILKSGRIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 5000 - protein, 411 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 5001 - protein, 560 aa, Homo sapiens
MELPAVGEHVFAVESIEKKRIRKGRVEYLVKWRGWSPKYNTWEPEENILDPRLLIAFQNRERQEQLMGYRKRGPKPKPLVVQVPTFARRSNVLTGLQDSSTDNRAKLDLGAQGKGQGHQYELNSKKHHQYQPHSKERAGKPPPPGKSGKYYYQLNSKKHHPYQPDPKMYDLQYQGGHKEAPSPTCPDLGAKSHPPDKWAQGAGAKGYLGAVKPLAGAAGAPGKGSEKGPPNGMMPAPKEAVTGNGIGGKMKIVKNKNKNGRIVIVMSKYMENGMQAVKIKSGEVAEGEARSPSHKKRAADERHPPADRTFKKAAGAEEKKVEAPPKRREEEVSGVSDPQPQDAGSRKLSPTKEAFGEQPLQLTTKPDLLAWDPARNTHPPSHHPHPHPHHHHHHHHHHHHAVGLNLSHVRKRCLSETHGEREPCKKRLTARSISTPTCLGGSPAAERPADLPPAAALPQPEVILLDSDLDEPIDLRCVKTRSEAGEPPSSLQVKPETPASAAVAVAAAAAPTTTAEKPPAEAQDEPAESLSEFKPFFGNIIITDVTANCLTVTFKEYVTV

SEQ ID NO: 5002 - protein, 405 aa, Homo sapiens
MDSLVTANTKFCFDLFQEIGKDDRHKNIFFSPLSLSAALGMVRLGARSDSAHQIDEVLHFNEFSQNESKEPDPCLKSNKQKAGSLNNESGLVSCYFGQLLSKLDRIKTDYTLSIANRLYGEQEFPICQEYLDGVIQFYHTTIESVDFQKNPEKSRQEINFWVECQSQGKIKELFSKDAINAETVLVLVNAVYFKAKWETYFDHENTVDAPFCLNANENKSVKMMTQKGLYRIGFIEEVKAQILEMRYTKGKLSMFVLLPSHSKDNLKGLEELERKITYEKMVAWSSSENMSEESVVLSFPRFTLEDSYDLNSILQDMGITDIFDETRADLTGISPSPNLYLSKIIHKTFVEVDENGTQAAAATGAVVSERSLRSWVEFNANHPFLFFIRHNKTQTILFYGRVCSP

SEQ ID NO: 5003 - protein, 1178 aa, Homo sapiens
MLRMKLPLKPTHPAEPPPEAEEPEADARPGAKAPSRRRRDCRPPPPPPPPAGPSRGPLPPPPPPRGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPLPIPSTFLPHSSTPALHLTVQRLKLPPPQGSSESCTVNIPQQPPGSLSIASPNTAFIPIHNPGSFPGSPVATTDPITKSASQVVGLNQMVPQIEGNTGTVPQPTNVKVVLPAAGLSAAQPPASYPLPGSPLAAGVLPSQNSSVLSTAATSPQPASAGISQAQATVPPAVPTHTPGPAPSPSPALTHSTAQSDSTSYISAVGNTNANGTVVPPQQMGSGPCGSCGRRCSCGTNGNLQLNSYYYPNPMPGPMYRVPSFFTLPSICNGSYLNQAHQSNGNQLPFFLPQTPYANGLVHDPVMGSQANYGMQQMAGFGRFYPVYPAPNVVANTSGSGPKKNGNVSCYNCGVSGHYAQDCKQSSMEANQQGTYRLRYAPPLPPSNDTLDSAD

SEQ ID NO: 5004 - protein, 136 aa, Homo sapiens
MPGKKARKNAQPSPARAPAGPAGTAGTARDQAGFAIGMQLRFTRGKKLLSSSLSSSPLALPRGHEEQVQVAGSRVCYSTQEIWRQTELPAETSESDIQTLLLRNLTASKTCMRGLLQKSFLRRCTFHQFEERLHCN

SEQ ID NO: 5005 - protein, 292 aa, Homo sapiens
MKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSACENSGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 5006 - protein, 669 aa, Homo sapiens
MDLRTAVYNAARDGKLQLLQKLLSGRSREELDELTGEVAGGGTPLLIAARYGHLDVVEYLVDRCGASVEAGGSVHFDGETIEGAPPLWAASAAGHLDVVRSLLRRGASVNRTTRTNSTPLRAACFDGHLEVVRYLVGEHQADLEVANRHGHTCLMISCYKGHREIARYLLEQGAQVNRRSAKGNTALHDCAESGSLEILQLLLGCKARMERDGYGMTPLLAASVTGHTNIVEYLIQEQPGQEQVAGGEAQPGLPQEDPSTSQGCAQPQGAPCCSSSPEEPLNGESYESCCPTSREAAVEALELLGATYVDKKRDLLGALKHWRRAMELRHQGGEYLPKPEPPQLVLAYDYSREVNTTEELEALITDPDEMRMQALLIRERILGPSHPDTSYYIRYRGAVYADSGNFERCIRLWKYALDMQQSNLEPLSPMTASSFLSFAELFSYVLQDRAAKGSLGTQIGFADLMGVLTKGVREVERALQLPREPGDSAQFTKALAIILHLLYLLEKVECTPSQEHLKHQTVYRLLKCAPRGKNGFTPLHMAVDKDTTNVGRYPVGRFPSLHVVKVLLDCGADPDSRDFDNNTPLHIAAQNNCPAIMNALIEAGAHMDATNAFKKTAYELLDEKLLARGTMQPFNYVTLQCLAARALDKNKIPYKGFIPEDLEAFIELH

SEQ ID NO: 5007 - protein, 239 aa, Homo sapiens
MAATLLAARGAGPAPAWGPEAFTPDWESREVSTGTTIMAVQFDGGVVLGADSRTTTGSYIANRVTDKLTPIHDRIFCCRSGSAADTQAVADAVTYQLGFHSIELNEPPLVHTAASLFKEMCYRYREDLMAGIIIAGWDPQEGGQVYSVPMGGMMVRQSFAIGGSGSSYIYGYVDATYREGMTKEECLQFTANALALAMERDGSSGGVIRLAAIAESGVERQVLLGDQIPKFAVATLPPA

SEQ ID NO: 5008 - protein, 460 aa, Homo sapiens
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGDFAVLSLCWHLSGDSMALLSKDHFCLCFLETEAVVGTACRQLGGHT

SEQ ID NO: 5009 - protein, 93 aa, Homo sapiens
MSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 5010 - protein, 639 aa, Homo sapiens
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSQADQDQQASGLQSPPSRDLSPTLIDNSAAKQLARNTVTQVLSRFTSQQGPIKPVSPNSSPFGTDYRNLANTANPRGDTSHSPTPGKVSSPLSPLSPGIKSPTIPRAERGNPPPIPPKKPGLTPSPSATTPLTKTHSQAASLTTAEDLASSCSSNTVVANGKDVELLLPTSS

SEQ ID NO: 5011 - protein, 828 aa, Homo sapiens
MRFLEARSLAVAMGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 5012 - protein, 1410 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 5013 - protein, 495 aa, Homo sapiens
MPQLLQNINGIIEAFRRYARTEGNCTALTRGELKRLLEQEFADVIVKPHDPATVDEVLRLLDEDHTGTVEFKEFLVLVFKVAQACFKTLSESAEGACGSQESGSLHSGASQELGEGQRSGTEVGRAGKGQHYEGSSHRQSQQGSRGQNRPGVQTQGQATGSAWVSSYDRQAESQSQERISPQIQLSGQTEQTQKAGEGKRNQTTEMRPERQPQTREQDRAHQTGETVTGSGTQTQAGATQTVEQDSSHQTGRTSKQTQEATNDQNRGTETHGQGRSQTSQAVTGGHAQIQAGTHTQTPTQTVEQDSSHQTGSTSTQTQESTNGQNRGTEIHGQGRSQTSQAVTGGHTQIQAGSHTETVEQDRSQTVSHGGAREQGQTQTQPGSGQRWMQVSNPEAGETVPGGQAQTGASTESGRQEWSSTHPRRCVTEGQGDRQPTVVGEEWVDDHSRETVILRLDQGNLHTSVSSAQGQDAAQSEEKRGITARELYSYLRSTKP

SEQ ID NO: 5014 - protein, 410 aa, Homo sapiens
MNMPSTPLAPTTGTATCSWSASTCTTTRPAVRPPSFPHRPPGNAALPSLMPSRPTQVAGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 5015 - protein, 701 aa, Homo sapiens
MGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 5016 - protein, 342 aa, Homo sapiens
MASVTRAVFGELPSGGGTVEKFQLQSDLLRVDIISWGCTITALEVKDRQGRASDVVLGFAELEGYLQKQPYFGAVIGRVANRIAKGTFKVDGKEYHLAINKEPNSLHGGVRGFDKVLWTPRVLSNGVQFSRISPDGEEGYPGELKVWVTYTLDGGELIVNYRAQASQATPVNLTNHSYFNLAGQASPNINDHEVTIEADTYLPVDETLIPTGEVAPVQGTAFDLRKPVELGKHLQDFHLNGFDHNFCLKGSKEKHFCARVHHAASGRVLEVYTTQPGVQFYTGNFLDGTLKGKNGAVYPKHSGFCLETQNWPDAVNQPRFPPVLLRPGEEYDHTTWFKFSVA

SEQ ID NO: 5017 - protein, 764 aa, Homo sapiens
MSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPGALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 5018 - protein, 76 aa, Homo sapiens
MSKAHPPELKKFMDKKLSLKLNGGRHVQGILRGFDPFMNLVIDECVEMATSGQQNNIGMVVIRGNSIIMLEALERV

SEQ ID NO: 5019 - protein, 175 aa, Homo sapiens
MQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQVEGHQVSLKNLPEIMNITEVKKIYKLSSQEESIGTLLDAIICRMSTKDVL

SEQ ID NO: 5020 - protein, 302 aa, Homo sapiens
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSGLEQAHAMPSPRILKTHLPFHLLPPSLLEKNCKIIYVARNPKDNMVSYYHFQRMNKALPAPGTWEEYFETFLAGKVCWGSWHEHVKGWWEAKDKHRILYLFYEDMKKNPKHEIQKLAEFIGKKLDDKVLDKIVHYTSFDVMKQNPMANYSSIPAEIMDHSISPFMRKGAVGDWKKHFTVAQNERFDEDYKKKMTDTRLTFHFQF

SEQ ID NO: 5021 - protein, 963 aa, Homo sapiens
MWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 5022 - protein, 236 aa, Homo sapiens
MASLDRVKVLVLGDSGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGDYDQEQFADNQIPLLVIGTKLDQIHETKRHEVLTRTAFLAEDFNPEEINLDCTNPRYLAAGSSNAVKLSRFFDKVIEKRYFLREGNQIPGFPDRKRFGAGTLKSLHYD

SEQ ID NO: 5023 - protein, 927 aa, Homo sapiens
MQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPGGPRNITIIVEDPIAESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 5024 - protein, 99 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 5025 - protein, 261 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 5026 - protein, 395 aa, Homo sapiens
MAEDGLPKIYSHPPTESSKTPTAATIFFGADNAIPKSETTITSEGDHVTSVNEYMLESDFSTTTDNKLTAKKEKLKSEDDMGTDFIKSTTHLQKEITSLTGTTNSITRDSITEHFMPVKIGNISSPVTTVSLIDFSTDIAKEDILLATIDTGDAEISITSEVSGTLKDSSAGVADAPAFPRKKDEADMSNYNSSIKSNVPADEAVQVTDSTIPEAEIPPAPEESFTTIPDITALEEEKITEIDLSVLEDDTSAVATLTDSDEKFITVFELTTSAEKDKDKREDTLLTDEETTEGASIWMERDTANEAETHSVLLTAVESRYDFVVPASIATNLVEESSTEEDLSETDNTETVPKITEPFSGTTSVLDTPDYKEDTSTTETDIFELLKEEPDEFMI

SEQ ID NO: 5027 - protein, 306 aa, Homo sapiens
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGRNSKHGFMTFF

SEQ ID NO: 5028 - protein, 302 aa, Homo sapiens
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKELALQEEKLRLEEEALYAAQREAARAAKQRKLLEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 5029 - protein, 546 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSCFSDNM

SEQ ID NO: 5030 - protein, 202 aa, Homo sapiens
MAVPAALILRESPSMKKAVSLINAIDTGRFPRLLTRILQKLHLKAESSFSEEEEEKLQAAFSLEKQDLHLVLETISFILEQAVYHNVKPAALQQQLENIHLRQDKAEAFVNTWSSMGQETVEKFRQRILAPCKLETVGWQLNLQMAHSAQAKLKSPQAVLQLGVNNEDSKSLEKVLVEFSHKELFDFYNKLETIQAQLDSLT

SEQ ID NO: 5031 - protein, 506 aa, Homo sapiens
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKVKYQSLKKQNVFNREQMQRMKLQIATLLQMKGSQTEFEQQERLLAMLEQKNGEIKHLLGEIRNLEKFKNLYDSMESKPSVDSGTLEDNTYYTDLLQMKLDNLNKEIESTKGELSIQRMKALFESQRALDIERKLFANERCLQLSESENMKLRAKLDELKLKYEPEETVEVPVLKKRREVLPVDITTAKDACVNNSALGGEVYRLPPQKEETQSCPNSLEDNNLQLEKSVSIYTPVVSLSPHKNLPVDMQLKKEKKCVKLIGVPADAEALSERSGNTPNSPRLAAESKLQTEVKEGKETSSKLEKETCKKLHPILYVSSKSTPETQCPQQ

SEQ ID NO: 5032 - protein, 613 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSGKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 5033 - protein, 217 aa, Homo sapiens
MSWTCPRCQQPVFFAEKVSSLGKNWHRFCLKCERCHSILSPGGHAEHNGRPYCHKPCYGALFGPRGVNIGGVGSYLYNPPTPSPGCTTPLSPSSFSPPRPRTGLPQGKKSPPHMKTFTGETSLCPGCGEPVYFAEKVMSLGRNWHRPCLRCQRCHKTLTAGSHAEHDGVPYCHVPCYGYLFGPKGGQPHPRHWDGMYMPEVWHVHGLWVCVDNFPCG

SEQ ID NO: 5034 - protein, 500 aa, Homo sapiens
MNQRRSESRPGNHRLQAYAEPGKGDSGGAGPLSGSARRGRGGGGAIRVRRPCWSGGAGRGGGPAWAVRLPTVTAGWTWPALRTLSSLRAGPSEPHSPGRRPPRAGRPLCQADPQPGKAARRSLEPDPAQTGPRPARAAGMSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 5035 - protein, 626 aa, Homo sapiens
MEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 5036 - protein, 531 aa, Homo sapiens
MAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 5037 - protein, 221 aa, Homo sapiens
MSAFGHDEAWMEAGGFGLEAAERTEYQSLCKSKLLFLGEQSGKTSIISRFMYNSFGCACQATVGIDFLSKTMYLEDQIVQLQLWDTAGQERFHSLIPSYIRDSTIAVVVYDITNINSFKETDKWVEHVRAERGDDVVIMLLGNKIDLDNKRQVTAEQGEEKSRNLNVMFIETSAKTGYNVKKLFRRVASALLSTRTSPPPKEGTVEIELESFEESGNRSYC

SEQ ID NO: 5038 - protein, 2073 aa, Homo sapiens
MAEVRKFTKRLSKPGTAAELRQSVSEAVRGSVVLEKAKVVEPLDYENVIAQRKTQIYSDPLRDLLMFPMEDISISVIGRQRRTVQSTVPEDAEKRAQSLFVKECIKTYSTDWHVVNYKYEDFSGDFRMLPCKSLRPEKIPNHVFEIDEDCEKDEDSSSLCSQKGGVIKQGWLHKANVNSTITVTMKVFKRRYFYLTQLPDGSYILNSYKDEKNSKESKGCIYLDACIDVVQCPKMRRHAFELKMLDKYSHYLAAETEQEMEEWLITLKKIIQINTDSLVQEKKETVETAQDDETSSQGKAENIMASLERSMHPELMKYGRETEQLNKLSRGDGRQNLFSFDSEVQRLDFSGIEPDIKPFEEKCNKRFLVNCHDLTFNILGQIGDNAKGPPTNVEPFFINLALFDVKNNCKISADFHVDLNPPSVREMLWGSSTQLASDGSPKGSSPESYIHGIAESQLRYIQQGIFSVTNPHPEIFLVARIEKVLQGNITHCAEPYIKNSDPVKTAQKVHRTAKQVCSRLGQYRMPFAWAARPIFKDTQGSLDLDGRFSPLYKQDSSKLSSEDILKLLSEYKKPEKTKLQIIPGQLNITVECVPVDLSNCITSSYVPLKPFEKNCQNITVEVEEFVPEMTKYCYPFTIYKNHLYVYPLQLKYDSQKTFAKARNIAVCVEFRDSDESDASALKCIYGKPAGSVFTTNAYAVVSHHNQNPEFYDEIKIELPIHLHQKHHLLFTFYHVSCEINTKGTTKKQDTVETPVGFAWVPLLKDGRIITFEQQLPVSANLPPGYLNLNDAESRRQCNVDIKWVDGAKPLLKIKSHLESTIYTQDLHVHKFFHHCQLIQSGSKEVPGELIKYLKCLHAMEIQVMIQFLPVILMQLFRVLTNMTHEDDVPINCTMVLLHIVSKCHEEGLDSYLRSFIKYSFRPEKPSAPQAQLIHETLATTMIAILKQSADFLSINKLLKYSWFFFEIIAKSMATYLLEENKIKLPRGQRFPETYHHVLHSLLLAIIPHVTIRYAEIPDESRNVNYSLASFLKRCLTLMDRGFIFNLINDYISGFSPKDPKVLAEYKFEFLQTICNHEHYIPLNLPMAFAKPKLQRVQDSNLEYSLSDEYCKHHFLVGLLLRETSIALQDNYEIRYTAISVIKNLLIKHAFDTRYQHKNQQAKIAQLYLPFVGLLLENIQRLAGRDTLYSCAAMPNSASRDEFPCGFTSPANRGSLSTDKDTAYGSFQNGHGIKREDSRGSLIPEGATGFPDQGNTGENTRQSSTRSSVSQYNRLDQYEIRSLLMCYLYIVKMISEDTLLTYWNKVSPQELINILILLEVCLFHFRYMGKRNIARVHDAWLSKHFGIDRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQIIIAVSQLIADVALSGGSRFQESLFIINNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQILQEDTMHSPWMSNTLHVFCAISGTSSDRGYGSPRYAEV

SEQ ID NO: 5039 - protein, 547 aa, Homo sapiens
MGGCIPFLKAARALCPRIMPPLLLLSAFIFLVSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 5040 - protein, 1870 aa, Homo sapiens
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFGVAFVKLMNPDGTTLQDGRHDLVVYKGDNKKMEDAKFYLTLPGTKMEMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKGAALKYLPSIINDVKLVFDPVELSVLFCKFIQSIPDNQLVRQKLNCMTKIVESTLFRQSECREVLLPLLTDQLSGQLDDNSNKPDHEASSQLLSNILEVLDRKDVGATAVHIQLIMERLLRRINRTVIGMNRQSPHIGSFVACMIALLQQMDDSHYSHYISTFKTRQDIIDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQWSDKPCVPHLLQKDSYYVYTQQELKEKLYQEIISYFDKGKMWEKAIKLSKELAETYESKVFDYEGLGNLLKKRASFYENIIKAMRPQPEYFAVGYYGQGFPSFLRNKIFIYRGKEYERREDFSLRLLTQFPNAEKMTSTTPPGEDIKSSPKQYMQCFTVKPVMSLPPSYKDKPVPEQILNYYRANEVQQFRYSRPFRKGEKDPDNEFATMWIERTTYTTAYTFPGILKWFEVKQISTEEISPLENAIETMELTNERISNCVQQHAWDRSLSVHPLSMLLSGIVDPAVMGGFSNYEKAFFTEKYLQEHPEDQEKVELLKRLIALQMPLLTEGIRIHGEKLTEQLKPLHERLSSCFRELKEKVEKHYGVITLPPNLTERKQSRTGSIVLPYIMSSTLRRLSITSVTSSVVSTSSNSSDNAPSRPGSDGSILEPLLERRASSGARVEDLSLREENSENRISKFKRKDWSLSKSQVIAEKAPEPDLMSPTRKAQRPKSLQLMDNRLSPFHGSSPPQSTPLSPPPLTPKATRTLSSPSLQTDGIAATPVPPPPPPKSKPYEGSQRNSTELAPPLPVRREAKAPPPPPPKARKSGIPTSEPGSQ

SEQ ID NO: 5041 - protein, 540 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQELVICLALLAFLILHYIWSQIQCLIFTLMDWI

SEQ ID NO: 5042 - protein, 1083 aa, Homo sapiens
MSQTQDYECRSHNVDLPESRIPGSNTRLEWVEIIEPRTRERMYANLVTGECVWDPPAGVRIKRTSENQWWELFDPNTSRFYYYNASTQRTVWHRPQGCDIIPLAKLQTLKQNTESPRASAESSPGRGSSVSREGSTSSSLEPEPDTEKAQELPARAGRPAAFGTVKEDSGSSSPPGVFLEKDYEIYRDYSADGQLLHYRTSSLRWNSGAKERMLIKVADREPSFLAAQGNGYAPDGPPGVRSRRPSGSQHSPSLQTFAPEADGTIFFPERRPSPFLKRAELPGSSSPLLAQPRKPSGDSQPSSPRYGYEPPLYEEPPVEYQAPIYDEPPMDVQFEAGGGYQAGSPQRSPGRKPRPFLQPNKQGPPSPCQQLVLTKQKCPERFLSLEYSPAGKEYVRQLVYVEQAGSSPKLRAGPRHKYAPNPGGGSYSLQPSPCLLRDQRLGVKSGDYSTMEGPELRHSQPPTPLPQAQEDAMSWSSQQDTLSSTGYSPGTRKRKSRKPSLCQATSATPTEGPGDLLVEQPLAEEQPPCGTSLAPVKRAEGEAEGARGAAEPFLAQARLAWEAQQAHFHMKQRSSWDSQQDGSGYESDGALPLPMPGPVVRAFSEDEALAQQENRHWRRGTFEKLGFPQILLEKSVSVQTNLASPEPYLHPSQSEDLAACAQFESSRQSRSGVPSSSCVFPTFTLRKPSSETDIENWASKHFNKHTQGLFRRKVSIANMLAWSSESIKKPMIVTSDRHVKKEACELFKLIQMYMGDRRAKADPLHVALEVATKGWSVQGLRDELYIQLCRQTTENFRLESLARGWELMAICLAFFPPTPKFHSYLEGYIYRHMDPVNDTKGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 5043 - protein, 141 aa, Homo sapiens
MGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 5044 - protein, 566 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRFPHVGGCSGSFS

SEQ ID NO: 5045 - protein, 421 aa, Homo sapiens
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGKTALLHALASSDGVQIHNTENIRLLLEGGADVKATTKDGDTVFTCIIFLLGETVGGDKEEAQMINRFCFQVTRLLLAHGADPSECPAHESLTHICLKSFKLHFPLLRFLLESGAAYNCSLHGASCWSGFHIIFERLCSHPGCTEDESHADLLRKAETVLDLMVTNSQKLQLPENFDIHPVGSLAEKIQALHFSLRQLESYPPPLKHLCRVAIRLYLQPWPVDVKVKALPLPDRLKWYLLSEHSGSVEDDI

SEQ ID NO: 5046 - protein, 197 aa, Homo sapiens
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDREKLLCSMLWPAATGCRSTILRTFVSYWKEGQTSRPPPKMGTQCSPASSSCLVRPWEGTKRRPR

SEQ ID NO: 5047 - protein, 227 aa, Homo sapiens
MSDINLDWVDRRQLQRLEEMLIVVDENDKVIGADTKRNCHLNENIEKGLLHRAFSVVLFNTKNRILIQQRSDTKVTFPGYFTDSCSSHPLYNPAELEEKDAIGVRRAAQRRLQAELGIPGEQISPEDIVFMTIYHHKAKSDRIWGEHEICYLLLVRKNVTLNPDPSETKSILYLSQEELWELLEREARGEVKVTPWLRTIAERFLYRWWPHLDDVTPFVELHKIHRV

SEQ ID NO: 5048 - protein, 287 aa, Homo sapiens
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 5049 - protein, 947 aa, Homo sapiens
MCVDSLVRICSGLSYGRIRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 5050 - protein, 846 aa, Homo sapiens
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPELLSPGVQRLSYLRTSSLSPTHSDSRPNPPFRHHFIPHIKGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 5051 - protein, 197 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYENFQRRLAQNPLFWKT

SEQ ID NO: 5052 - protein, 309 aa, Homo sapiens
MVFPAKRFCLVPSMEGVRWAFSCGTWLPSRAEWLLAVRSIQPEEKERIGQFVFARDAKAAMAGRLMIRKLVAEKLNIPWNHIRLQRTAKGKPVLAKDSSNPYPNFNFNISHQGDYAVLAAEPELQVGIDIMKTSFPGRGSIPEFFHIMKRKFTNKEWETIRSFKDEWTQLDMFYRNWALKESFIKAIGVGLGFELQRLEFDLSPLNLDIGQVYKETRLFLDGEEEKEWAFEESKIDEHHFVAVALRKPDGSRHQDVPSQDDSKPTQRQFTILNFNDLMSSAVPMTPEDPSFWDCFCFTEEIPIRNGTKS

SEQ ID NO: 5053 - protein, 532 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHGSSTKQQPGHLFSSKCPEQPLDANRGAVKPMQVLFSGEATHRKYYSTTHGALLSGQREAARLIEMYRDLFQQGT

SEQ ID NO: 5054 - protein, 782 aa, Homo sapiens
MDSSIHLSSLISRHDDEATRTSTSEGLEEGEVEGETLLIVESEDQASVDLSHDQSGDSLNSDEGDVSWMEEQLSYFCDKCQKWIPASQLREQLSYLKGDNFFRFTCSDCSADGKEQYERLKLTWQQVVMLAMYNLSLEGSGRQGYFRWKEDICAFIEKHWTFLLGNRKKTSTWWSTVAGCLSVGSPMYFRSGAQEFGEPGWWKLVHNKPPTMKPEGEKLSASTLKIKAASKPTLDPIITVEGLRKRASRNPVESAMELKEKRSRTQEAKDIRRAQKEAAGFLDRSTSSTPVKFISRGRRPDVILEKGEVIDFSSLSSSDRTPLTSPSPSPSLDFSAPGTPASHSATPSLLSEADLIPDVMPPQALFHDDDEMEGDGVIDPGMEYVPPPAGSVASGPVVGVRKKVRGPEQIKQEVESEEEKPDRMDIDSEDTDSNTSLQTRAREKRKPQLEKDTKPKEPRYTPVSIYEEKLLLKRLEACPGAVAMTPEARRLKRKLIVRQAKRDRGLPLFDLDQVVNAALLLVDGIYGAKEGGISRLPAGQATYRTTCQDFRILDRYQTSLPSRKGFRHQTTKFLYRLVGSEDMAVDQSIVSPYTSRILKPYIRRDYETKPPKLQLLSQIRSHLHRSDPHWTPEPDAPLDYCYVRPNHIPTINSMCQEFFWPGIDLSECLQYPDFSVVVLYKKVIIAFGFMVPDVKYNEAYISFLFVHPEWRRAGIATFMIYHLIQTCMGKDVTLHVSASNPAMLLYQKFGFKTEEYVLDFYDKYYPLESTECKHAFFLRLRR

SEQ ID NO: 5055 - protein, 914 aa, Homo sapiens
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWLQQEEEERRHQELLQKKKEEEQERLRKAAEAKRLAEQREQERREQERREQERREQERREQERREQERQLAEQERRREQERLQAERELQEREKALRLQKEQLQRELEEKKKKEEQQRLAERQLQEEQEKKAKEAAGASKALNVTVDVQSPACTSYQMTPQGHRAPPKINPDNYGMDLNSDDSTDDEAHPRKPIPTWARGTPLSQAIIHQYYHPPNLLELFGTILPLDLEDIFKKSKPRYHKRTSSAVWNSPPLQGARVPSSLAYSLKKH

SEQ ID NO: 5056 - protein, 1382 aa, Homo sapiens
MDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRREAEAELSGELSGLGALPARRDLTLELEEPPQGPLPRGSQRSEQLELERALKLQPCASEKRAQMCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMWEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 5057 - protein, 1460 aa, Homo sapiens
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVSLGSSVESGRQLGELMLPSQGLKTSAYTKGLLGSIYEDKTALSLLGLGEETNEEDEEESDNQSVHSSSEPLRNLHLDIGALGGDFEYEESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERLSPPLPHEERAQSPPRSLATEEEPPQGPEGQPEWKEAEELGEDSAASLSLQLSLQREQAPSPPAACEKGKEQHSQAEELGPGQEEAEDPEEKVAVSPTPPVSPEVRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVQQTRSMRRRQTALKAAQQHWRHELASAQEVAKDPPGIKALEDMRKNLEKETRHLDEMKSAMRKGHNLLKKKEEKLNQLESSLWEEASDEGTLGGSPTKKAVTFDLSDMDSLSSESSESFSPPHREWWRQQRIDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 5058 - protein, 626 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISITDIKMTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 5059 - protein, 332 aa, Homo sapiens
MATIKSELIKNFAEEEAIHHNKISIVGTGSVGVACAISILLKGLSDELVLVDVDEGKLKGETMDLQHGSPFMKMPNIVSSKDYLVTANSNLVIITAGARQKKGETRLDLVQRNVSIFKLMIPNITQYSPHCKLLIVTNPVDILTYVAWKLSGFPKNRVIGSGCNLDSARFRYFIGQRLGIHSESCHGLILGEHGDSSVPVWSGVNIAGVPLKDLNPDIGTDKDPEQWENVHKKVISSGYEMVKMKGYTSWGISLSVADLTESILKNLRRVHPVSTLSKGLYGINEDIFLSVPCILGENGITDLIKVKLTLEEEACLQKSAETLWEIQKELKL

SEQ ID NO: 5060 - protein, 323 aa, Homo sapiens
MPEMPEDMEQEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 5061 - protein, 1094 aa, Homo sapiens
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVENLTRELENGEKQQLQMLDRLKEIQNHFDTCEAERKHADLQISELTRHAEDATKQAERYLSELQQSEALKEEAEKRREDLKLKAQESIRQWKLKHKKLERALEKQSETVDELTGKNNQILKEKDELKTQLYAALQQIENLRKELNDVLTKRALQEEELHSKEEKLRDIKSHQADLELEVKNSLDTIHRLESELKKQSKIQSQMKVEKAHLEEEIAELKKSQAQDKAKLLEMQESIKDLSAIRADLANKLAEEERAKKAVLKDLSDLTAQAKSRDEETATIITQLKLERDVHQRELKDLTSSLQSVKTKHEQNIQELMKHFKKEKSEAENHIRTLKAESLEEKNMAKIHRGQLEKLKSQCDRLTEELTQNENENKKLKLKYQCLKDQLEEREKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVPEKLSLLEDFKDFRDSCSSSERTDGRYSKYRVRRNSLQHHQDDTKYRTKSFKGDRTFLEGSHTRGLDHSSSWQDHSRFLSSPRFSYVNSFTKRTVAPDSASNKEDATMNGTSSQPKKEEYGS

SEQ ID NO: 5062 - protein, 336 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIGISQRDYTQYYDHISKQKEEIRRCIQDFFKKHIQYKFLDEDFVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 5063 - protein, 415 aa, Homo sapiens
MKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 5064 - protein, 589 aa, Homo sapiens
MPTVSVKRDLLFQALGRTYTDEEFDELCFEFGLELDEITSEKEIISKEQGNVKAAGASDVVLYKIDVPANRYDLLCLEGLVRGLQVFKERIKAPVYKRVMPDGKIQKLIITEETAKIRPFAVAAVLRNIKFTKDRYDSFIELQEKLHQNICRKRALVAIGTHDLDTLSGPFTYTAKRPSDIKFKPLNKTKEYTACELMNIYKTDNHLKHYLHIIENKPLYPVIYDSNGVVLSMPPIINGDHSRITVNTRNIFIECTGTDFTKAKIVLDIIVTMFSEYCENQFTVEAAEVVFPNGKSHTFPELAYRKEMVRADLINKKVGIRETPENLAKLLTRMYLKSEVIGDGNQIEIEIPPTRADIIHACDIVEDAAIAYGYNNIQMTLPKTYTIANQFPLNKLTELLRHDMAAAGFTEALTFALCSQEDIADKLGVDISATKAVHISNPKTAEFQVARTTLLPGLLKTIAANRKMPLPLKLFEISDIVIKDSNTDVGAKNYRHLCAVYYNKNPGFEIIHGLLDRIMQLLDVPPGEDKGGYVIKASEGPAFFPGRCAEIFARGQSVGKLGVLHPDVITKFELTMPCSSLEINVGPFL

SEQ ID NO: 5065 - protein, 158 aa, Homo sapiens
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 5066 - protein, 224 aa, Homo sapiens
MVEDELALFDKSINEFWNKFKSTDTSCQMAGLRDTYKDSIKAFAEKLSVKLKEEERMVEMFLEYQNQISRQNKLIQEKKDNLLKLIAEVKGKKQELEVLTANIQDLKEEYSRKKETISTANKANAERLKRLQKSADLYKDRLGLEIRKIYGEKLQFIFTNIDPKNPESPFMFSLHLNEARDYEVSDSAPHLEGLAEFQENVRKTNNFSAFLANVRKAFTATVYN

SEQ ID NO: 5067 - protein, 575 aa, Homo sapiens
MKLTDSTKGWIVWAALDSSMRGMSLSAGSSPLHSPKITPHTSPAPRRRSHTPNPASYMVPSSASTSVNNPVSQTPSSGQVIQKETVGGTTYFYTDTTPAPLTGMVFPNYHIYPPTAPHVAYMQPKANAPSFFMADELRQELINRHLITMAQIDQADMPAVPTEVDSYHSLFPLEPLPPPNRIQKSSNFGYITSCYKAVNSKDDLPYCLRRIHGFRLVNTKCMVLVDMWKKIQHSNIVTLREVFTTKAFAEPSLVFAYDFHAGGETMMSRHFNDPNADAYFTKRKWGQHEGPLPRQHAGLLPESLIWAYIVQLSSALRTIHTAGLACRVMDPTKILITGKTRLRVNCVGVFDVLTFDNSQNNNPLALMAQYQQADLISLGKVVLALACNSLAGIQRENLQKAMELVTINYSSDLKNLILYLLTDQNRMRSVNDIMPMIGARFYTQLDAAQMRNDVIEEDLAKEVQNGRLFRLLAKLGTINERPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 5068 - protein, 594 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 5069 - protein, 388 aa, Homo sapiens
MLEGSWINRREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 5070 - protein, 247 aa, Homo sapiens
MEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQESWDLEEKLLDIRKKRLQLKQASESKLLEIQTEKNKQKIDLDSMENSERIKIIRQNLQMEIKITTVIQHVFQNLILGSKVNWAEDPALKEIVLQLEKNVDMM

SEQ ID NO: 5071 - protein, 485 aa, Homo sapiens
MEFLGTTQTASYCGPKKCCGLTSLPAVQAPVIQECYQPYYLPGYRYLNSWRPSLFYKIANVQTCPDESTSTLRPPTILPTLRSALFSRYSPHDWDQSNQLQVRGAEASRLWASRLTDDSMRLLQDKDQLTHQMQEGTCRNLGQRLSDIGFWKSELSYELDRLLTENQNLETVKRRLECAANEVNCPLQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIQLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 5072 - protein, 278 aa, Homo sapiens
MGKSSEWCERIAGIQKFVLEKWTKKAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 5073 - protein, 825 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAAGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 5074 - protein, 314 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 5075 - protein, 299 aa, Homo sapiens
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 5076 - protein, 856 aa, Homo sapiens
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 5077 - protein, 328 aa, Homo sapiens
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSGSNPARPGGFPGANSPGPVADLYGPASQDSGVGNYISAASPQPGSGFGHGIAGPLIATAFTNGYH

SEQ ID NO: 5078 - protein, 217 aa, Homo sapiens
MESVALYSFQATESDELAFNKGDTLKILNMEDDQNWYKAELRGVEGFIPKNYIRVKPHPWYSGRISRQLAEEILMKRNHLGAFLIRESESSPGEFSVSVNYGDQVQHFKVLREASGKYFLWEEKFNSLNELVDFYRTTTIAKKRQIFLRDEEPLLKSPGACFAQAQFDFSAQDPSQLSFRRGDIIEVLERPDPHWWRGRSCGRVGFFPRSYVQPVHL

SEQ ID NO: 5079 - protein, 76 aa, Homo sapiens
MGLKMSCLKGFQMCVSSSSSSHDEAPVLNDKHLDVPDIIITPPTPTGMMLPRDLGSTVWLDETGSCPDDGEIDPEA

SEQ ID NO: 5080 - protein, 6620 aa, Homo sapiens
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTQFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEVTEQETKVPKKTVIIEETITTVVKSPRGQRRSPSKSPSRSPSRCSASPLRPGLLAPDLLYLPGAGQPRRPEAEPGQKPVVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGQPVLLSVGHALGPRGPLGLFRPEPRGASPPGPQVRSLEGTSFLLREAPARPVGSAPWTQSFCTRIRRSADSGQSSFTTELSTQTVNFGTVGETVTLHICPDRDGDEAAQP

SEQ ID NO: 5081 - protein, 468 aa, Homo sapiens
MAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGDVTLDPDTANPELILSEDRRSVQRGDLRQALPDSPERFDPGPCVLGQERFTSGRHYWEVEVGDRTSWALGVCRENVNRKEKGELSAGNGFWILVFLGSYYNSSERALAPLRDPPRRVGIFLDYEAGHLSFYSATDGSLLFIFPEIPFSGTLRPLFSPLSSSPTPMTICRPKGGSGDTLAPQ

SEQ ID NO: 5082 - protein, 270 aa, Homo sapiens
MSPGSGVKSEYMKRYQEPRWEEYGPCYRELLHYRLGRRLLEQAHAPWLWDDWGPAGSSEDSASSESSGAGGPAPRCAPPSPPPPVEPATQEEAERRARGAPEEQDAEAGDAEAEDAEDAALPALPVKDVEDKPEQQTRTRETDKSPTSTEPRQQPSALFARGNRKAVKSPQRSSSKIKENKHPFALYGWGEKQTDTGSQKTHNVCASAPVHEIHESALRAKNRRQVEKRKLVAQRQRAHSVDVEKNRKMKASSSENPWMTEYMRCYSARA

SEQ ID NO: 5083 - protein, 888 aa, Homo sapiens
MDESALLDLLECPVCLERLDASAKVLPCQHTFCKRCLLGIVGSRNELRCPECRTLVGSGVEELPSNILLVRLLDGIKQRPWKPGPGGGSGTNCTNALRSQSSTVANCSSKDLQSSQGGQQPRVQSWSPPVRGIPQLPCAKALYNYEGKEPGDLKFSKGDIIILRRQVDENWYHGEVNGIHGFFPTNFVQIIKPLPQPPPQCKALYDFEVKDKEADKDCLPFAKDDVLTVIRRVDENWAEGMLADKIGIFPISYVEFNSAAKQLIEWDKPPVPGVDAGECSSAAAQSSTAPKHSDTKKNTKKRHSFTSLTMANKSSQASQNRHSMEISPPVLISSSNPTAAARISELSGLSCSAPSQVHISTTGLIVTPPPSSPVTTGPSFTFPSDVPYQAALGTLNPPLPPPPLLAATVLASTPPGATAAAAAAGMGPRPMAGSTDQIAHLRPQTRPSVYVAIYPYTPRKEDELELRKGEMFLVFERCQDGWFKGTSMHTSKIGVFPGNYVAPVTRAVTNASQAKVPMSTAGQTSRGVTMVSPSTAGGPAQKLQGNGVAGSPSVVPAAVVSAAHIQTSPQAKVLLHMTGQMTVNQARNAVRTVAAHNQERPTAAVTPIQVQNAAGLSPASVGLSHHSLASPQPAPLMPGSATHTAAISISRASAPLACAAAAPLTSPSITSASLEAEPSGRIVTVLPGLPTSPDSASSACGNSSATKPDKDSKKEKKGLLKLLSGASTKRKPRVSPPASPTLEVELGSAELPLQGAVGPELPPGGGHGRAGSCPVDGDGPVTTAVAGAALAQDAFHRKASSLDSAVPIAPPPRQACSSLGPVLNESRPVVCERHRVVVSYPPQSEAELELKEGDIVFVHKKREDGWFKGTLQRNGKTGLFPGSFVENI

SEQ ID NO: 5084 - protein, 189 aa, Homo sapiens
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQKTGTTLNTSIIFGPNLS

SEQ ID NO: 5085 - protein, 364 aa, Homo sapiens
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSGCSTPSGIDCGSGRSTPSSVSTVSTICPGDLKVAAKLAPNIPLEMELPGVKIVHAQFNTPMQLYSDDNIMETLQGQVSTALGETPLMSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 5086 - protein, 316 aa, Homo sapiens
MPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQEFKPIGTAHNRRAQPFVAAANIDDKRQVVSASYNSPIGLYSTSNIQDALHGQLRGLIPSSPQNEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 5087 - protein, 1100 aa, Homo sapiens
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 5088 - protein, 1462 aa, Homo sapiens
MFRGPKPPIAPKPRLTAPNEWRASVYLNDSLNKCSNGRLPCVDRGLDEGPRSIPKCSESETDEDYIVVPRVPLREDEPKDEGSVGNKALVSPESSAEEEEEREEGGEACGLEGTGAGEDSVAPAAPGAGALSREGEEGTDLALEDEGEGCADEPGTLEQVSRSEEEEKLVQPHRECSLEDSGPWAGEGVFQSDLLLPHIHGEDQEPPDTPGEAEEDDEEGCASTDPAGADEGSGPDRPTEDMGQDAEDTSEEPPEKEELAGVQEAETATDCPEVLEEGCEEATGVTGGEQVDLSEPPDHEKKTNQEVAAATLEDHAQDESAEESCQIVPFENDCMEDFVTSLTGSPYEFFPTESTSFCSESCSPLSESAKGLESEQAPKLGLRAEENPMVGALCGQCGSLQGGAAEGPAAPDVVVVLEEEALDDALANPYVMGVGLPGQAAPGEGGQAASDALGGYGSKEELNCEAEGGLVPADRKNTSTRVRPHSGKVAGYVPETVPEETGPEAGSSAPGIGGAAEEVGKTLLSLEGKPLEASRALPAKPRAFTLYPRSFSVEGREIPVSVYQEPEGSGLDDHRIKRKEDNLSLSCVIGSSGSFSQRNHLPSSGTSTPSSMVDIPPPFDLACITKKPITKSSPSLLIESDSPDKYKKKKSSFKRFLALTFKKKTENKLHVDVNVSSSRSSSESSYHGPSRILEVDRRSLSNSPQLKSRTGKLRASESPSSLIFYRDGKRKGVPFSRTVSRVESFEDRSRPPFLPLPLTKPRSISFPSADTSDYENIPAMNSDYENIQIPPRRPARAGAFTKLFEDQSRALSTANENDGYVDMSSFNAFESKQQSADQDAESAYTEPYKVCPISSAAPKEDLTSDEEQRSSEEEDSASRDPSVTHKVEGQSRALVIAQELLSSEKAYVEMLQHLNLDFHGAVMRALDDMDHEGRDTLAREELRQGLSELPAIHDLHQGILEELEERLSNWESQQKVADVFLAREQGFDHHATHILQFDRYLGLLSENCLHSPRLAAAVREFEQSVQGGSQTAKHRLLRVVQRLFQYQVLLTDYLNNLCPDSAEYDNTQGALSLISKVTDRANDSMEQGENLQKLVHIEHSVRGQGDLLQPGREFLKEGTLMKVTGKNRRPRHLFLMNDVLLYTYPQKDGKYRLKNTLAVANMKVSRPVMEKVPYALKIETSESCLMLSASSCAERDEWYGCLSRALPEDYKAQALAAFHHSVEIRERLGVSLGERPPTLVPVTHVMMCMNCGCDFSLTLRRHHCHACGKIVCRNCSRNKYPLKYLKDRMAKVCDGCFGELKKRGRAVPGLMRERPVSMSFPLSSPRFSGSAFSSVFQSINPSTFKKQKKVPSALTEVAASGEGSAISGYLSRCKRGKRHWKKLWFVIKGKVLYTYMASEDKVALESMPLLGFTIAPEKEEGSSEVGPIFHLYHKKTLFYSFKAEDTNSAQRWIEAMEDASVL

SEQ ID NO: 5089 - protein, 255 aa, Homo sapiens
MASSDLEQLCSHVNEKIGNIKKTLSLRNCGQEPTLKTVLNKIGDEIIVINELLNKLELEIQYQEQTNNSLKELCESLEEDYKDIEHLKENVPSHLPQVTVTQSCVKGSDLDPEEPIKVEEPEPVKKPPKEQRSIKEMPFITCDEFNGVPSYMKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 5090 - protein, 208 aa, Homo sapiens
MSAGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 5091 - protein, 1055 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 5092 - protein, 1087 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSIMMTPNMQGIIMAIGKSRSVYDRCGPEAGFFKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 5093 - protein, 852 aa, Homo sapiens
MSSVSPIQIPSRLPLLLTHEGVLLPGSTMRTSVDSARNLQLVRSRLLKGTSLQSTILGVIPNTPDPASDAQDLPPLHRIGTAALAVQVVGSNWPKPHYTLLITGLCRFQIVQVLKEKPYPIAEVEQLDRLEEFPNTCKMREELGELSEQFYKYAVQLVEMLDMSVPAVAKLRRLLDSLPREALPDILTSIIRTSNKEKLQILDAVSLEERFKMTIPLLVRQIEGLKLLQKTRKPKQDDDKRVIAIRPIRRITHISGTLEDEDEDEDNDDIVMLEKKIRTSSMPEQAHKVCVKEIKRLKKMPQSMPEYALTRNYLELMVELPWNKSTTDRLDIRAARILLDNDHYAMEKLKKRVLEYLAVRQLKNNLKGPILCFVGPPGVGKTSVGRSVAKTLGREFHRIALGGVCDQSDIRGHRRTYVGSMPGRIINGLKTVGVNNPVFLLDEVDKLGKSLQGDPAAALLEVLDPEQNHNFTDHYLNVAFDLSQVLFIATANTTATIPAALLDRMEIIQVPGYTQEEKIEIAHRHLIPKQLEQHGLTPQQIQIPQVTTLDIITRYTREAGVRSLDRKLGAICRAVAVKVAEGQHKEAKLDRSDVTEREGCREHILEDEKPESISDTTDLALPPEMPILIDFHALKDILGPPMYEMEVSQRLSQPGVAIGLAWTPLGGEIMFVEASRMDGEGQLTLTGQLGDVMKESAHLAISWLRSNAKKYQLTNAFGSFDLLDNTDIHLHFPAGAVTKDGPSAGVTIVTCLASLFSGRLVRSDVAMTGEITLRGLVLPVGGIKDKVLAAHRAGLKQVIIPRRNEKDLEGIPGNVRQDLSFVTASCLDEVLNAAFDGGFTVKTRPGLLNSKL

SEQ ID NO: 5094 - protein, 129 aa, Homo sapiens
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQIRQTPFES

SEQ ID NO: 5095 - protein, 474 aa, Homo sapiens
MDEAGSSASGGGFRPGVDSLDEPPNSRIFLVISKYTPESVLRERFSPFGDIQDIWVVRDKHTKESKGIAFVKFARSSQACRAMEEMHGQCLGPNDTKPIKVFIAQSRSSGSHRDVEDEELTRIFVMIPKSYTEEDLREKFKVYGDIEYCSIIKNKVTGESKGLGYVRYLKPSQAAQAIENCDRSFRAILAEPKNKASESSEQDYYSNMRQEALGHEPRVNMFPFEQQSEFSSFDKNDSRGQEAISKRLSVVSRVPFTEEQLFSIFDIVPGLEYCEVQRDPYSNYGHGVVQYFNVASAIYAKYKLHGFQYPPGNRIGVSFIDDGSNATDLLRKMATQMVAAQLASMVWNNPSQQQFMQFGGSSGSQLPQIQTDVVLPSCKKKAPAETPVKERLFIVFNPHPLPLDVLEDIFCRFGNLIEVYLVSGKNVGYAKYADRISANDAIATLHGKILNGVRLKVMLADSPREESNKRQRTY

SEQ ID NO: 5096 - protein, 645 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 5097 - protein, 445 aa, Homo sapiens
MYPNPLIYCTCWDPWNLGPRKLIKTPQLPRKNSTGSSKLTPLVPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 5098 - protein, 623 aa, Homo sapiens
MEPPQETNRPFSTLDNRSGQVQVLSATPLLQRNPYSSPDIMHIKGSEASSVPYALNQGTTALPKNKNQEGTGHRLLNMLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMFMNLAPPPERTDPVTKVITPQTVEYPAFLSPDLNVTVGTPAVQSSNQPSVVRLEKLQQQPRERLEKMKKEYRNLNTWIDKANYLESILMPKLEHKDSEETNIDEASENTKSNHPEEELENIVGVDIPLVNEEAETTANELLDNDSEKGLTIPTLNQSDQDNSTADASKNDESTPSPTEVHSLCTISNQETIKAGRIPPLGERQSESMPDRKMKNVFFPLEVKLKDNYPSILKADSSLSEVAFSPKEYNSPSFRPEYIEFKPKFQDCSDKFEDLHDMTSFTHLKKVKSRSRLLGKSSDDIHNHARHSARPYTAPEVNKQRESYSGKFTSRRMVSSGLVHINDKTSDYEMHKMRPKKIKRGY

SEQ ID NO: 5099 - protein, 1197 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRSLVALSLILSMLLFKPAPIYILDEVDAALDLSHTQNIGQMLRTHFTHSQFIVVSLKEGMFNNANVLFKTKFVDGVSTVARFTQCQNGKISKEAKSKAKPPKGAHVEV

SEQ ID NO: 5100 - protein, 359 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNNFTIYTTVMSAGSPDKYMTRIRNPSRK

SEQ ID NO: 5101 - protein, 548 aa, Homo sapiens
MALHVPKAPGFAQMLKEGAKHFSGLEEAVYRNIQACKELAQTTRTAYGPNGMNKMVINHLEKLFVTNDAATILRELEVQHPAAKMIVMASHMQEQEVGDGTNFVLVFAGALLELAEELLRIGLSVSEVIEGYEIACRKAHEILPNLVCCSAKNLRDIDEVSSLLRTSIMSKQYGNEVFLAKLIAQACVSIFPDSGHFNVDNIRVCKILGSGISSSSVLHGMVFKKETEGDVTSVKDAKIAVYSCPFDGMITETKGTVLIKTAEELMNFSKGEENLMDAQVKAIADTGANVVVTGGKVADMALHYANKYNIMLVRLNSKWDLRRLCKTVGATALPRLTPPVLEEMGHCDSVYLSEVGDTQVVVFKHEKEDGAISTIVLRGSTDNLMDDIERAVDDGVNTFKVLTRDKRLVPGGGATEIELAKQITSYGETCPGLEQYAIKKFAEAFEAIPRALAENSGVKANEVISKLYAVHQEGNKNVGLDIEAEVPAVKDMLEAGILDTYLGKYWAIKLATNAAVTVLRVDQIIMAKPAGGPKPPSGKKDWDDDQND

SEQ ID NO: 5102 - protein, 229 aa, Homo sapiens
MNIRNAQPDDLMNMQHCNLLCLPENYQMKYYLYHGLSWPQLSYIAEDEDGKIVGYVLAKMEEEPDDVPHGHITSLAVKRSHRRLGLAQKLMDQASRAMIENFNAKYVSLHVRKSNRPALHLYSNTLNFQISEVEPKYYADGEDAYAMKRDLSQMADELRRQMDLKKGGYVVLGSRENQETQGSTLSDSEEACQQKNPATEESGSDSKEPKESVESTNVQDSSESSDSTS

SEQ ID NO: 5103 - protein, 457 aa, Homo sapiens
MSALRRSGYGPSDGPSYGRYYGPGGGDVPVHPPPPLYPLRPEPPQPPISWRVRGGGPAETTWLGEGGGGDGYYPSGGAWPEPGRAGGSHQEQPPYPSYNSNYWNSTARSRAPYPSTYPVRPELQGQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 5104 - protein, 1066 aa, Homo sapiens
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 5105 - protein, 205 aa, Homo sapiens
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 5106 - protein, 657 aa, Homo sapiens
MSQVLFHQLVPLQVKCKDCEERRVSIRMSIELQSVSNPVHRKDLVIRLTDDTDPFFLYNLVISEEDFQSLKFQQGLLVDFLAFPQKFIDLLQQCTQEHAKEIPRFLLQLVSPAAILDNSPAFLNVVETNPFKHLTHLSLKLLPGNDVEIKKFLAGCLKCSKEEKLSLMQSLDDATKQLDFTRKTLAEKKQELDKLRNEWASHTAALTNKHSQELTNEKEKALQAQVQYQQQHEQQKKDLEILHQQNIHQLQNRLSELEAANKDLTERKYKGDSTIRELKAKLSGVEEELQRTKQEVLSLRRENSTLDVECHEKEKHVNQLQTKVAVLEQEIKDKDQLVLRTKEAFDTIQEQKVVLEENGEKNQVQLGKLEATIKSLSAELLKANEIIKKLQGDLKTLMGKLKLKNTVTIQQEKLLAEKEEKLQKEQKELQDVGQSLRIKEQEVCKLQEQLEATVKKLEESKQLLKNNEKLITWLNKELNENQLVRKQDVLGPSTTPPAHSSSNTIRSGISPNLNVVDGRLTYPTCGIGYPVSSAFAFQNTFPHSISAKNTSHPGSGTKVQFNLQFTKPNASLGDVQSGATISMPCSTDKENGENVGLESKYLKKREDSIPLRGLSQNLFSNSDHQRDGTLGALHTSSKPTALPSASSAYFPGQLPNS

SEQ ID NO: 5107 - protein, 78 aa, Homo sapiens
MRFMMMRAENFFILRRKPVEGYDISFLITNFHTEQMYKHKLVDFVIHFMEEIDKEISEMKLSVNARARIVAEEFLKNF

SEQ ID NO: 5108 - protein, 310 aa, Homo sapiens
MPLLVEGRRVRLPQSAGDLVRAHPPLEERARLLRGQSVQQVGPQGLLYVQQRELAVTSPKDGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFSGNKALLYKKNEDGLWEKISSPGS

SEQ ID NO: 5109 - protein, 307 aa, Homo sapiens
MTETTKTHVILLACGSFNPITKGHIQMFERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 5110 - protein, 491 aa, Homo sapiens
MEEGKMDENEWGYHGEGNKSLVVAHAQRCVVLRFLKFPPNRKKTSEEIFQHLQNIVDFGKNVMKEFLGENYVHYGEVVQLPLEFVKQLCLKIQSERPESRCDKDLDTLSGYAMCLPNLTRLQTYRFAEHRPILCVEIKPKCGFIPFSSDVTHEMKHKVCRYCMHQHLKVATGKWKQISKYCPLDLYSGNKQRMHFALKSLLQEAQNNLKIFKNGELIYGCKDARSPVADWSELAHHLKPFFFPSNGLASGPHCTRAVIRELVHVITRVLLSGSDKGRAGTLSPGLGPQGPRVCEASPFSRSLRCQGKNTPERSGLPKGCLLYKTLQVQMLDLLDIEGLYPLYNRVERYLEEFPEERKTLQIDGPYDEAFYQKLLDLSTEDDGTVAFALTKVQQYRVAMTAKDCSIMIALSPCLQDASSDQRPVVPSSRSRFAFSVSVLDLDLKPYESIPHQYKLDGKIVNYYSKTVRAKDNAVMSTRFKESEDCTLVLHKV

SEQ ID NO: 5111 - protein, 879 aa, Homo sapiens
MMFYRLLSIVGRQRASPGWQNWSSARNSTSAAEARSMALPTQAQVVICGGGITGTSVAYHLSKMGWKDIVLLEQGRLAAGSTRFCAGILSTARHLTIEQKMADYSNKLYYQLEQETGIQTGYTRTGSIFLAQTQDRLISLKRINAGLNVIGIPSEIISPKKVAELHHLLNVHDLVGAMHVPEDAVVSSADVALALASAASQNGVQIYDRTSVLHVMVKKGQVTGVETDKGQIECQYFVNCAGQWAYELGLSNEEPVSIPLHACEHFYLLTRPLETPLQSSTPTIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITSTGDQALEVLQYLFSNDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 5112 - protein, 479 aa, Homo sapiens
MATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLKPQLLQGVYAMGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 5113 - protein, 1084 aa, Homo sapiens
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 5114 - protein, 712 aa, Homo sapiens
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTMAGGLGLNFVGANVVVLFDPTWNPANDLQAIDRAYRIGQCRDVKVLRLISLGTVEEIMYLRQIYKQQLHCVVVGSENAKRYFEAVQGSKEHQGELFGIHNLFKFRSQGSCLTKDILEV

SEQ ID NO: 5115 - protein, 403 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPLLMKILLEHQHRSEPFLGIGLKTTLKITSSLQLRIHFGDMTQKLIPELYSCY

SEQ ID NO: 5116 - protein, 1220 aa, Homo sapiens
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDNDSEELEDKDSKSKKTAKPKVEMYSGSDDDDDFNKLPKKAKGKAQKSNKKWDGSEEDEDNSKKIKERSRINSSGESGDESDEFLQSRKGQKKNQKNKPGPNIESGNEDDDASFKIKTVAQKKAEKKERERKKRDEEKAKLRKLKEKEELETGKKDQSKQKESQRKFEEETVKSKVTVDTGVIPASEEKAETPTAAEDDNEGDKKKKDKKKKKGEKEEKEKEKKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNKVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 5117 - protein, 45 aa, Homo sapiens
MSDKPDLSEVEKFDRSKLKKTNTEEKNTLPSKETIQQEKECVQTS

SEQ ID NO: 5118 - protein, 510 aa, Homo sapiens
MPGGGASAASGRLLTAAEQRGSREAAGSASRSGFGGSGGGRGGASGPGSGSGGPGGPAGRMSLTPKELSSLLSIISEEAGGGSTFEGLSTAFHHYFSKADHFRLGSVLVMLLQQPDLLPSAAQRLTALYLLWEMYRTEPLAANPFAASFAHLLNPAPPARGGQEPDRPPLSGFLPPITPPEKFFLSQLMLAPPRELFKKTPRQIALMDVGNMGQSVDISGLQLALAERQSELPTQSKASFPSILSDPDPDSSNSGFDSSVASQITEALVSGPKPPIESHFRPEFIRPPPPLHICEDELAWLNPTEPDHAIQWDKSMCVKNSTGVEIKRIMAKAFKSPLSSPQQTQLLGELEKDPKLVYHIGLTPAKLPDLVENNPLVAIEMLLKLMQSSQITEYFSVLVNMDMSLHSMEVVNRLTTAVDLPPEFIHLYISNCISTCEQIKDKYMQNRLVRLVCVFLQSLIRNKIINVQDLFIEVQAFCIEFSRIREAAGLFRLLKTLDTGETPSETKMSK

SEQ ID NO: 5119 - protein, 727 aa, Homo sapiens
MSGRKRSFTFGAYGGVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 5120 - protein, 290 aa, Homo sapiens
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKRLEENDDDAYLNSPWADNTALKRHFHGVKDIKWRPR

SEQ ID NO: 5121 - protein, 188 aa, Homo sapiens [sequence omitted]

SEQ ID NO: 5122 - protein, 677 aa, Homo sapiens
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 5123 - protein, 244 aa, Homo sapiens
MGLELFLDLVSQPSRAVYIFAKKNGIPLELRTVDLVKGQHKSKEFLQINSLGKLPTLKDGDFILTESSAILIYLSCKYQTPDHWYPSDLQARARVHEYLGWHADCIRGTFGIPLWVQVLGPLIGVQVPEEKVERNRTAMDQALQWLEDKFLGDRPFLAGQQVTLADLMALEELMQPVALGYELFEGRPRLAAWRGRVEAFLGAELCQEAHSIILSILEQAAKKTLPTPSPEAYQAMLLRIARIP

SEQ ID NO: 5124 - protein, 176 aa, Homo sapiens
MAASTDMAGLEESFRKFAIHGDPKASGQEMNGKNWAKLCKDCKVADGKSVTGTDVDIVFSKVKGKSARVINYEEFKKALEELATKRFKGKSKEEAFDAICQLVAGKEPANVGVTKAKTGGAVDRLTDTSRYTGSHKERFDESGKGKGIAGRQDILDDSGYVSAYKNAGTYDAKVKK

SEQ ID NO: 5125 - protein, 309 aa, Homo sapiens
MSDLGSEELEEEGENDIGEYEGGRNEAGERHGRGRARLPNGDTYEGSYEFGKRHGQGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERGEEEEEEELVTVVPKWKATQITELALWTPTLPKKPTSTDGPGQDAPGAESAGEPGEEAQALLEGFEGEMDMRPGDEDADVLREESREYDQEEFRYDMDEGNINSEEEETRQSDLQD

SEQ ID NO: 5126 - protein, 1980 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 5127 - protein, 1048 aa, Homo sapiens
MSDVNPPSDTPIPFSSSSTHSSHIPPWTFSCYPGSPCENGVMLYMRNVSHEELQRFKQLLLTELSTGTMPITWDQVETASWAEVVHLLIERFPGRRAWDVTSNIFAIMNCDKMCVVVRREINAILPTLEPEDLNVGETQVNLEEGESGKIRRYKSNVMEKFFPIWDITTWPGNQRDFFYQGVHRHEEYLPCLLLPKRPQGRQPKTVAIQGAPGIGKTILAKKVMFEWARNKFYAHKRWCAFYFHCQEVNQTTDQSFSELIEQKWPGSQDLVSKIMSKPDQLLLLLDGFEELTSTLIDRLEDLSEDWRQKLPGSVLLSSLLSKTMLPEATLLIMIRFTSWQTCKPLLKCPSLVTLPGFNTMEKIKYFQMYFGHTEEGDQVLSFAMENTILFSMCRVPVVCWMVCSGLKQQMERGNNLTQSCPNATSVFVRYISSLFPTRAENFSRKIHQAQLEGLCHLAADSMWHRKWVLGKEDLEEAKLDQTGVTAFLGMSILRRIAGEEDHYVFTLVTFQEFFAALFYVLCFPQRLKNFHVLSHVNIQRLIASPRGSKSYLSHMGLFLFGFLNEACASAVEQSFQCKVSFGNKRKLLKVIPLLHKCDPPSPGSGVPQLFYCLHEIREEAFVSQALNDYHKVVLRIGNNKEVQVSAFCLKRCQYLHEVELTVTLNFMNVWKLSSSSHPGSEAPESNGLHRWWQDLCSVFATNDKLEVLTMTNSVLGPPFLKALAAALRHPQCKLQKLLLRRVNSTMLNQDLIGVLTGNQHLRYLEIQHVEVESKAVKLLCRVLRSPRCRLQCLRLEDCLATPRIWTDLGNNLQGNGHLKTLILRKNSLENCGAYYLSVAQLERLSIENCNLTQLTCESLASCLRQSKMLTHLSLAENALKDEGAKHIWNALPHLRCPLQRLVLRKCDLTFNCCQDMISALCKNKTLKSLDLSFNSLKDDGVILLCEALKNPDCTLQILELENCLFTSICCQAMASMLRKNQHLRHLDLSKNAIGVYGILTLCEAFSSQKKREEVIFCIPAWTRITSFSPTPHPPDFTGKSDCLSQINP

SEQ ID NO: 5128 - protein, 1263 aa, Homo sapiens
MPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 5129 - protein, 1464 aa, Homo sapiens
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 5130 - protein, 433 aa, Homo sapiens
MAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 5131 - protein, 527 aa, Homo sapiens
MAQTLQMEIPNFGNSILECLNEQRLQGLYCDVSVVVKGHAFKAHRAVLAASSSYFRDLFNNSRSAVVELPAAVQPQSFQQILSFCYTGRLSMNVGDQFLLMYTAGFLQIQEIMEKGTEFFLKVSSPSCDSQGLHAEEAPSSEPQSPVAQTSGWPACSTPLPLVSRVKTEQQESDSVQCMPVAKRLWDSGQKEAGGGGNGSRKMAKFSTPDLAANRPHQPPPPQQAPVVAAAQPAVAAGAGQPAGGVAAAGGVVSGPSTSERTSPGTSSAYTSDSPGSYHNEEDEEEDGGEEGMDEQYRQICNMYTMYSMMNVGQTAEKVEALPEQVAPESRNRIRVRQDLASLPAELINQIGNRCHPKLYDEGDPSEKLELVTGTNVYITRAQLMNCHVSAGTRHKVLLRRLLASFFDRNTLANSCGTGIRSSTNDPRRKPLDSRVLHAVKYYCQNFAPNFKESEMNAIAADMCTNARRVVRKSWMPKVKVLKAEDDAYTTFISETGKIEPDMMGVEHGFETASHEGEAGPSAEALQ

SEQ ID NO: 5132 - protein, 223 aa, Homo sapiens
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 5133 - protein, 499 aa, Homo sapiens
MRVLVPPAERSQDTRVGAPAWREAAQAMARTAHILTDRCGQEAVTMWQPKDSVLDPNVAHHLGRAAYIQPWRFRVEMIKGGGTLEKPPPGEGVTLWKGKMKPPAWYARLPLPLHRKARALQTTEVVHAHARGARLTAARLGRAQHQINGRVRQLLRQREVTDHRLSEVRKGLLINQQSVKLRGYRPKSEKVPDKADSMLTWEKEELKSMKRKMERDMEKSEVLLKTLASCRDTLNFCFKERLQAVDLMNQPLDKVLEQARRHSWVNLSRAPTPRTQGQKTPPPDPVGTYNPACALALNEAKRLLVESKDTLVEMAKNEVDVREQQLQISDRVCASLAQKASETLELKERLNMTLGLMRGTILRCTKYNQELYTTHGLIKGPLSKVHLETAEKLDRPLVRMYQRHVGTQLPEAARLAQGTDKLQCHITYLEKNLDELLATHKNLSWGLNCKNIGHEVDGNVVRLRLRQRQPHVCYEQAQRLVKDWDPRTPPPRSKSSADP

SEQ ID NO: 5134 - protein, 608 aa, Homo sapiens
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFLKSELCLDNCIGICKFTDYYYCPELRQKAYMFILHNFEEMVKVSAEFLELSVTELKDIIEKDELNVKQEDAVFEAILKWISHDPQNRKQHISILLPKVRLALMHAEYFMNNVKMNDYVKDSEECKPVIINALKAMYDLNMNGPSNSDFTNPLTRPRLPYAILFAIGGWSGGSPTNAIEAYDARADRWVNVTCEEESPRAYHGAAYLKGYVYIIGGFDSVDYFNSVKRFDPVKKTWHQVAPMHSRRCYVSVTVLGNFIYAMGGFDGYVRLNTAERYEPETNQWTLIAPMHEQRSDASATTLYGKVYICGGFNGNECLFTAEVYNTESNQWTVIAPMRSRRSGIGVIAYGEHVYAVGGFDGANRLRSAEAYSPVANTWRTIPTMFNPRSNFGIEVVDDLLFVVGGFNGFTTTFNVECYDEKTDEWYDAHDMSIYRSALSCCVVPGLANVEEYAARRDNFPGLALRDEVKYSASTSTLPV

SEQ ID NO: 5135 - protein, 313 aa, Homo sapiens
MAALTDLSFMYRWFKNCNLVGNLSEKYVFITGCDSGFGNLLAKQLVDRGMQVLAACFTEEGSQKLQRDTSYRLQTTLLDVTKSESIKAAAQWVRDKVGEQGLWALVNNAGVGLPSGPNEWLTKDDFVKVINVNLVGLIEVTLHMLPMVKRARGRVVNMSSSGGRVAVIGGGYCVSKFGVEAFSDSIRRELYYFGVKVCIIEPGNYRTAILGKENLESRMRKLWERLPQETRDSYGEDYFRIYTDKLKNIMQVAEPRVRDVINSMEHAIVSRSPRIRYNPGLDAKLLYIPLAKLPTPVTDFILSRYLPRPADSV

SEQ ID NO: 5136 - protein, 486 aa, Homo sapiens
MTCGSYCGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEIRVLQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVGSVNVCVSSSRGGVVCGDLCASTTAPVVSTRVSSVPSNSNVVVGTTNACAPSARVGVCGGSCKRC

SEQ ID NO: 5137 - protein, 312 aa, Homo sapiens
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGMAARLETRTRNWGSREACLGKGGMQREGAL

SEQ ID NO: 5138 - protein, 134 aa, Homo sapiens
MPADLSGTWTLLSSDNFEGYMLALGIDFATRKIAKLLKPQKVIEQNGDSFTIHTNSSLRNYFVKFKVGEEFDEDNRGLDNRKCKSLVIWDNDRLTCIQKGEKKNRGWTHWIEGDKLHLEMFCEGQVCKQTFQRA

SEQ ID NO: 5139 - protein, 460 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 5140 - protein, 402 aa, Homo sapiens
GGPRGSGSAAETMPEIRVTPLGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMNLLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 5141 - protein, 620 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQILKQWEEYSVLAWVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSDPETP

SEQ ID NO: 5142 - protein, 154 aa, Homo sapiens
MSKNTVSSARFRKVDVDEYDENKFVDEEDGGDGQAGPDEGEVDSCLRHSITGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 5143 - protein, 981 aa, Homo sapiens
MSEQERIQECLRKEIRSLLISTKDGLSPQELEKEYLLMVGNHLPLRILGYRSTMELVLDMPDVVRVCPGAGGTVILKAIPDESTKGIASLVAKQRSSHKLRNSMHKGRPSIYSGPRSHRRVPYRGRVAPILPAVVKSELKDLLALSPVLLSDFEKAFAKRFGRSFQYMQYGFLSMFEVLNAASDVISVEQTRAGSLLMLKKSVTEEKPRGCPAGKIFTQPFRMKQGSYSTGFPVAKPCFSQPTSNMEPPKQIMSMEKTSKLNVVETSRLNHTEKLNQLENTFKSVIAQIGPGGTISSELKHKIKFVVSKFPEGLFISKLLGEYEVIFKEQLSPKKLGFLNVTELVGALSDILHVEFRKGHQDLLVFDADKKPLPPVQSDKKIEAKACVSSPPRNSLSTAAVKETVWNCPSKKQKEPQQKICKKPNLVVKPLQLQVETNKSELNLAMANHDIPPDAVPNKKLCRLPPLDTSSLIGVFVEYIISPSQFYIRIYSRDSSELLEDMMIEMRRCYSNQLVSDRYVMPECFIQPGHLCCVRISEDKWWYRVIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKNTGTNRTQKQLDINGSSDSSTLPKLEEFCTSLTQSEQSADGSQSEPNNSQTQPKQIQLSTAAPCSTTAVDDSAEKPSGSVESSPEILKNEDFSSSRAITLYKDKRQESVDQLSLILSYECQISQKLYIPRSTATAALGAAARLATSRSLLHWYPSVKRMEA

SEQ ID NO: 5144 - protein, 302 aa, Homo sapiens
MEIQELEEIQACQGLWEVFVTLSERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 5145 - protein, 286 aa, Homo sapiens
MERRLGVRAWVKENRGSFQPPVCNKLMHQEQLKVMFIGGPNTRKDYHIEEGEEVFYQLEGDMVLRVLEQGKHRDVVIRQGEIFLLPARVPHSPQRFANTVGLVVERRRLETELDGLRYYVGDTMDVLFEKWFYCKDLGTQLAPIIQEFFSSEQYRTGKPIPDQLLKEPPFPLSTRSIMEPMSLDAWLDSHHRELQAGTPLSLFGDTYETQVIAYGQGSSEGLRQNVDVWLWQLEGSSVVTMGGRRLSLAPDDSLLVLAGTSYAWERTQGSVALSVTQDPACKKPLG

SEQ ID NO: 5146 - protein, 514 aa, Homo sapiens
MQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 5147 - protein, 179 aa, Homo sapiens
MGILFTRIWRLFNHQEHKVIIVGLDNAGKTTILYQFSMNEVVHTSPTIGSNVEEIVINNTRFLMWDIGGQESLRSSWNTYYTNTEFVIVVVDSTDRERISVTREELYKMLAHEDLRKAGLLIFANKQDVKECMTVAEISQFLKLTSIKDHQWHIQACCALTGEGLCQGLEWMMSRLKIR

SEQ ID NO: 5148 - protein, 475 aa, Homo sapiens
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDGIYRVSGNLATIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 5149 - protein, 435 aa, Homo sapiens
MAQTVPPCELPCKEYDVARNTGAYTSSGLATASFRTSKYLLEEWFQNCYARYHQAFADRDQSERQRHESQQLATETQALAQRTQQDSTRTVGERLQDTHSWKSELQREMEALAAETNLLLAQKQRLERALDATEVPFSITTDNLQCRERREHPNLVRDHVETELLKEAELIRNIQELLKRTIMQAVSQIRLNREHKETCEMDWSDKMEAYNIDETCGRHHSQSTEVQAHPYSTTFQESASTPETRAKFTQDNLCRAQRERLASANLRVLVDCILRDTSEDLRLQCDAVNLAFGRRCEELEDARYKLHHHLHKTLREITDQEHNVAALKQAIKDKEAPLHVAQTRLYLRSHRPNMELCRDAAQFRLLSEVEELNMSLTALREKLLEAEQSLRNLEDIHMSLEKDIAAMTNSLFIDRQKCMAHRTRYPTILQLAGYQ

SEQ ID NO: 5150 - protein, 275 aa, Homo sapiens
MRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 5151 - protein, 796 aa, Homo sapiens
MEEEASRSAAATNPGSRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 5152 - protein, 459 aa, Homo sapiens
MAASASAAAGEEDWVLPSEVEVLESIYLDELQVIKGNGRTSPWEIYITLHPATAEDQDSQYVCFTLVLQVPAEYPHEVPQISIRNPRGLSDEQIHTILQVLGHVAKAGLGTAMLYELIEKGKEILTDNNIPHGQCVICLYGFQEKEAFTKTPCYHYFHCHCLARYIQHMEQELKAQGQEQEQERQHATTKQKAVGVQCPVCREPLVYDLASLKAAPEPQQPMELYQPSAESLRQQEERKRLYQRQQERGGIIDLEAERNRYFISLQQPPAPAEPESAVDVSKGSQPPSTLAAELSTSPAVQSTLPPPLPVATQHICEKIPGTRSNQQRLGETQKAMLDPPKPSRGPWRQPERRHPKGGECHAPKGTRDTQELPPPEGPLKEPMDLKPEPHSQGVEGPPQEKGPGSWQGPPPRRTRDCVRWERSKGRTPGSSYPRLPRGQGAYRPGTRRESLGLESKDGS

SEQ ID NO: 5153 - protein, 692 aa, Homo sapiens
MGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 5154 - protein, 122 aa, Homo sapiens
MAPQKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 5155 - protein, 311 aa, Homo sapiens
MQYISHIFGVINCNGFTLSDQRGLQAVGVGIFPNLGLVNHDCWPNCTVIFNNGKIELRALGKISEGEELTVSYIDFLNVSEERKRQLKKQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKKQ

SEQ ID NO: 5156 - protein, 513 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 5157 - protein, 389 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 5158 - protein, 139 aa, Homo sapiens
MANIAVQRIKREFKEVLKSEETSKNQIKVDLVDENFTELRGEIAGPPDTPYEGGRYQLEIKIPETYPFNPPKYKQNPEMFKQTARLWAHVYAGAPVSSPEYTKKIENLCAMGFDRNAVIVALSSKSWDVETATELLLSN

SEQ ID NO: 5159 - protein, 400 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKKQDLTLLPRLECSGTNTTYCSLDLPSSSDPPILASQNTKIIDSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 5160 - protein, 65 aa, Homo sapiens [sequence omitted]

SEQ ID NO: 5161 - protein, 972 aa, Homo sapiens
MRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMLCQAKGFICEFCQNEDDIIFPFELHKCRTCEECKACYHKACFKSGSCPRCERLQARREALARQSLESYLSDYEEEPAEALALEAAVLEAT

SEQ ID NO: 5162 - protein, 386 aa, Homo sapiens [sequence omitted]

SEQ ID NO: 5163 - protein, 245 aa, Homo sapiens
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIINMSSVASSVKGVVNRCVYSTTKAAVIGLTKSVAADFIQQGIRCNCVCPGTVDTPSLQERIQARGNPEEARNDFLKRQKTGRFATAEEIAMLCVYLASDESAYVTGNPVIIDGGWSL

SEQ ID NO: 5164 - protein, 839 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 5165 - protein, 407 aa, Homo sapiens
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 5166 - protein, 390 aa, Homo sapiens
MATGDLKRSLRNLEQVLRLLNYPEEVDCVGLIKGDPAASLPIISYSFTSYSPYVTELIMESNVELIAKNDLRFIDAVYKLLRDQFNYKPILTKKQFIQCGFAEWKIQIVCDILNCVMKKHKELSSLQKIPSQQRKKISSGKSEPPLGNEKISAEAVGVDISGRFMTSGKKKAVVIRHLYNEDNVDISEDTLSPITDVNEAVDVSDLNATEIKMPEVKVPEIKAEQQDVNVNPEITALQTMLAECQENLKKLTSIEKRLDCLEQKMKGKVMVDENTWTNLLSRVTLLETEMLLSKKNDEFIEFNEVSEDYASCSDMDLLNPHRKSEVERPASIPLSSGYSTASSDSTPRASTVNYCGLNEISEETTIQKMERMKKMFEETAELLKCPNHYL

SEQ ID NO: 5167 - protein, 866 aa, Homo sapiens
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTAVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 5168 - protein, 430 aa, Homo sapiens
MASSAKSAEMPTISKTVNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 5169 - protein, 1732 aa, Homo sapiens
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELERILAPYTDFHYRHSPDTAEGQLKEDREARFLASKMGIIATFRSWAGIINLCKPGNSGIQSLIGVLCIPNMEIRRGLLEVLYDIFRLPLPVVTEEFIEALLSVDPGRFQDSWRLSDGFVAAEAKTILPHRARSRPDLMDNYLALILSAFIRNGLLEGLVEVITNSDDHISVRATILLGELLHMANTILPHSHSHHLHCLPTLMNMAASFDIPKEKRLRASAALNCLKRFHEMKKRGPKPYSLHLDHIIQKAIATHQKRDQYLRVQKDIFILKDTEEALLINLRDSQVLQHKENLEWNWNLIGTILKWPNVNLRNYKDEQLHRFVRRLLYFYKPSSKLYANLDLDFAKAKQLTVVGCQFTEFLLESEEDGQGYLEDLVKDIVQWLNASSGMKPERSLQNNGLLTTLSQHYFLFIGTLSCHPHGVKMLEKCSVFQCLLNLCSLKNQDHLLKLTVSSLDYSRDGLARVILSKILTAATDACRLYATKHLRVLLRANVEFFNNWGIELLVTQLHDKNKTISSEALDILDEACEDKANLHALIQMKPALSHLGDKGLLLLLRFLSIPKGFSYLNERGYVAKQLEKWHREYNSKYVDLIEEQLNEALTTYRKPVDGDNYVRRSNQRLQRPHVYLPIHLYGQLVHHKTGCHLLEVQNIITELCRNVRTPDLDKWEEIKKLKASLWALGNIGSSNWGLNLLQEENVIPDILKLAKQCEVLSIRGTCVYVLGLIAKTKQGCDILKCHNWDAVRHSRKHLWPVVPDDVEQLCNELSSIPSTLSLNSESTSSRHNSESESVPSSMFILEDDRFGSSSTSTFFLDINEDTEPTFYDRSGPIKDKNSFPFFASSKLVKNRILNSLTLPNKKHRSSSDPKGGKLSSESKTSNRRIRTLTEPSVDFNHSDDFTPISTVQKTLQLETSFMGNKHIEDTGSTPSIGENDLKFTKNFGTENHRENTSRERLVVESSTSSHMKIRSQSFNTDTTTSGISSMSSSPSRETVGVDATTMDTDCGSMSTVVSTKTIKTSHYLTPQSNHLSLSKSNSVSLVPPGSSHTLPRRAQSLKAPSIATIKSLADCNFSYTSSRDAFGYATLKRLQQQRMHPSLSHSEALASPAKDVLFTDTITMKANSFESRLTPSRIDFKKKHVGGIRSLRPTITNNLFRFMKALSYASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASSTKSTELLLGVKTIPDDTPMCRILLRKEVLRLVINLSSSVSTKCHETGLLTIKEKYPQTFDDICLYSEVSHLLSHCTFRLPCRRFIQELFQDVQFLQMHEEAEAVLATPPKQPIVDTSAES

SEQ ID NO: 5170 - protein, 586 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQMEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 5171 - protein, 394 aa, Homo sapiens
MALEVGDMEDGQLSDSDSDMTVAPSDRPLQLPKVLGGDSAMRAFQNTATACAPVSHYRAVESVDSSEESFSDSDDDSCLWKRKRQKCFNPPPKPEPFQFGQSSQKPPVAGGKKINNIWGAVLQEQNQDAVATELGILGMEGTIDRSRQSETYNYLLAKKLRKESQEHTKDLDKELDEYMHGGKKMGSKEEENGQGHLKRKRPVKDRLGNRPEMNYKGRYEITAEDSQEKVADEISFRLQEPKKDLIARVVRIIGNKKAIELLMETAEVEQNGGLFIMNGSRRRTPGGVFLNLLKNTPSISEEQIKDIFYIENQKEYENKKAARKRRTQVLGKKMKQAIKSLNFQEDDDTSRETFASDTNEALASLDESQEGHAEAKLEAEEAIEVDHSHDLDIF

SEQ ID NO: 5172 - protein, 262 aa, Homo sapiens
MFLFSRKTRTPISTYSDSYRAPTSIKEVYKDPPLCAWEANKFLTPGLTHTMERHVDPEALQKMAKCAVQDYTYRGSISGHPYLPEKYWLSQEEADKCSPNYLGSDWYNTWRMEPYNSSCCNKYTTYLPRLPKEARMETAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 5173 - protein, 1401 aa, Homo sapiens
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 5174 - protein, 255 aa, Homo sapiens
MVKGEKGPKGKKITLKVARNCIKITFDGKKRLDLSKMGITTFPKCILRLSDMDELDLSRNLIRKIPDSISKFQNLRWLDLHSNYIDKLPESIGQMTSLLYLNVSNNRLTSNGLPVELKQLKNIRAVNLGLNHLDSVPTTLGALKELHEVGLHDNLLNNIPVSISKLPKLKKLNIKRNPFPKPGESEIFIDSIRRLENLYVVEEKDLCAACLRKCQNARDNLNRIKNMATTTPRKTIFPNLISPNSMAKDSWEDWR

SEQ ID NO: 5175 - protein, 214 aa, Homo sapiens [sequence omitted]

SEQ ID NO: 5176 - protein, 1076 aa, Homo sapiens
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPSLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 5177 - protein, 320 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPITKNHKDYPFHIEY

SEQ ID NO: 5178 - protein, 412 aa, Homo sapiens
MSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 5179 - protein, 479 aa, Homo sapiens
MDATIAPHRIPPEMPQYGEENHIFELMQNMLEQLLIHQPEDPIPFMIQHLHRDNDNVPRIVILGPPASGKTTIAMWLCKHLNSSLLTLENLILNEFSYTATEARRLYLQRKTVPSALLVQLIQERLAEEDCIKQGWILDGIPETREQALRIQTLGITPRHVIVLSAPDTVLIERNLGKRIDPQTGEIYHTTFDWPPESEIQNRLMVPEDISELETAQKLLEYHRNIVRVIPSYPKILKVISADQPCVDVFYQALTYVQSNHRTNAPFTPRVLLLGPVGSGKSLQAALLAQKYRLVNVCCGQLLKEAVADRTTFGELIQPFFEKEMAVPDSLLMKVLSQRLDQQDCIQKGWVLHGVPRDLDQAHLLNRLGYNPNRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 5180 - protein, 143 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGADAAEWDWLCVKCQQYLSKA

SEQ ID NO: 5181 - protein, 396 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQSFTLLPTLEYSGTVSAHCNLRLPGSSNSRASASHVAGIKCARHHTRLIFFCILVETEFHHVAKAGLELLSSGNPPISDFQSARITGVSHHA

SEQ ID NO: 5182 - protein, 1471 aa, Homo sapiens
MEPEPVEDCVQSTLAALYPPFEATAPTLLGQVFQVVERTYREDALRYTLDFLVPAKHLLAKVQQEACAQYSGFLFFHEGWPLCLHEQVVVQLAALPWQLLRPGDFYLQVVPSAAQAPRLALKCLAPGGGRVQEVPVPNEACAYLFTPEWLQGINKDRPTGRLSTCLLSAPSGIQRLPWAELICPRFVHKEGLMVGHQPSTLPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPLSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAPETLDSSGDVSPGPRNSPSLQPPHPGSSTPTLASRGILGLSRQSHARALSDPTTPL

SEQ ID NO: 5183 - protein, 1519 aa, Homo sapiens
MEPEPVEDCVQSTLAALYPPFEATAPTLLGQVFQVVERTYREDALRYTLDFLVPAKHLLAKVQQEACAQYSGFLFFHEGWPLCLHEQVVVQLAALPWQLLRPGDFYLQVVPSAAQAPRLALKCLAPGGGRVQEVPVPNEACAYLFTPEWLQGINKDRPTGRLSTCLLSAPSGIQRLPWAELICPRFVHKEGLMVGHQPSTLPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPLSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAARTRASVAVSSFEHAGPSLPGLSPGACSLPARVEEEAWDLDVKQISLAPETLDSSGDVSPGPRNSPSLQPPHPGSSTPTLASRGILGLSRQSHARALSDPTTPL

SEQ ID NO: 5184 - protein, 902 aa, Homo sapiens
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 5185 - protein, 1077 aa, Homo sapiens
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEVFNVNAPLPPRKEQEIKESPYSPGYNQSFTTASTQTPPQCQLPSIHVEQTVHSQETANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 5186 - protein, 351 aa, Homo sapiens
MTLRLLEDWCRGMDMNPRKALLIAGISQSCSVAEIEEALQAGLAPLGEYRLLGRMFRRDENRKVALVGLTAETSHALVPKEIPGKGGIWRVIFKPPDPDNTFLSRLNEFLAGEGMTVGELSRALGHENGSLDPEQGMIPEMWAPMLAQALEALQPALQCLKYKKLRVFSGRESPEPGEEEFGRWMFHTTQMIKAWQVPDVEKRRRLLESLRGPALDVIRVLKINNPLITVDECLQALEEVFGVTDNPRELQVKYLTTYQKDEEKLSAYVLRLEPLLQKLVQRGAIERDAVNQARLDQVIAGAVHKTIRRELNLPEDGPAPGFLQLLVLIKDYEAAEEEEALLQAILEGNFT

SEQ ID NO: 5187 - protein, 852 aa, Homo sapiens
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLKTLIEYEVPQLLSSVAESSSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 5188 - protein, 720 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLFSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 5189 - protein, 447 aa, Homo sapiens
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 5190 - protein, 491 aa, Homo sapiens
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 5191 - protein, 104 aa, Homo sapiens
MAGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 5192 - protein, 245 aa, Homo sapiens
MIGVSFEEAKSIITGAKLSTRLESAWEIAFIRQKSDNIQPENLSCTSLIEASGEYGPQASTLSLFSSPPEILIPKTSSTPKTNNDILSSCEIKTGYNKTVQIPITSENSTVGLSNTDVASAWTENYGLQEKISLNPSVRFKAEKLEMALNYLGIQPTKEQHQALRQQVQADSKGTVSFGDFVQVARNLFCLQLDEVNVGAHEISNILDSQLLPCDSSEADEMERLKCERDDALKEVNTLKWPGQN

SEQ ID NO: 5193 - protein, 282 aa, Homo sapiens
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLRSPSFVQGWSVVVLSQLTAASTFQAEAILPSQSPTWLTLQVLATMPN

SEQ ID NO: 5194 - protein, 203 aa, Homo sapiens
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 5195 - protein, 179 aa, Homo sapiens
MKTPVELAVSGMQTLGLQHRCRGGYRVKARTSYVDETLFGSPAGTRPTPPDFDPPWVEKANRTRGVGKEASKALGAKGSCETTPSRGSTPTLTPRKKNKYRPISHTPSYCDESLFGSRSEGASFGAPRMAKGDAAKLRALLWTPPPTPRGSHSPRPREAPPPVPPTQMGLRISGLPRQG

SEQ ID NO: 5196 - protein, 367 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGSSSSCAIRASRRRFSSSSADLAGRGGGDGSIPAQHSTGASGKAPPPTLLLET

SEQ ID NO: 5197 - protein, 196 aa, Homo sapiens
MGSRSSHAAVIPDGDSIRRETGFSQASLLRLHHRFRALDRNKKGYLSRMDLQQIGALAVNPLGDRIIESFFPDGSQRVDFPGFVRVLAHFRPVEDEDTETQDPKKPEPLNSRRNKLHYAFQLYDLDRDGKISRHEMLQVLRLMVGVQVTEEQLENIADRTVQEADEDGDGAVSFVEFTKSLEKMDVEQKMSIRILK

SEQ ID NO: 5198 - protein, 770 aa, Homo sapiens
MFRYESLEDCPLDEDEDAFQGLGEEDEEIDQFNDDTFGSGAVDDDWQEAHERLAELEEKLPVAVNEQTGNGERDEMDLLGDHEENLAERLSKMVIENELEDPAIMRAVQTRPVLQPQPGSLNSSIWDGSEVLRRIRGPLLAQEMPTVSVLEYALPQRPPQGPEDDRDLSERALPRRSTSPIIGSPPVRAVPIGTPPKQMAVPSFTQQILCPKPVHVRPPMPPRYPAPYGERMSPNQLCSVPNSSLLGHPFPPSVPPVLSPLQRAQLLGGAQLQPGRMSPSQFARVPGFVGSPLAAMNPKLLQGRVGQMLPPAPGFRAFFSAPPSATPPPQQHPPGPGPHLQNLRSQAPMFRPDTTHLHPQHRRLLHQRQQQNRSQHRNLNGAGDRGSHRSSHQDHLRKDPYANLMLQREKDWVSKIQMMQLQSTDPYLDDFYYQNYFEKLEKLSAAEEIQGDGPKKERTKLITPQVAKLEHAYKPVQFEGSLGKLTVSSVNNPRKMIDAVVTSRSEDDETKEKQVRDKRRKTLVIIEKTYSLLLDVEDYERRYLLSLEEERPALMDDRKHKICSMYDNLRGKLPGQERPSDDHFVQIMCIRKGKRMVARILPFLSTEQAADILMTTARNLPFLIKKDAQDEVLPCLLSPFSLLLYHLPSVSITSLLRQLMNLPQSAATPALSNPHLTAVLQNKFGLSLLLILLSRGEDLQSSDPATESTQNNQWTEVMFMATRELLRIPQAALAKPISIPTNLVSLFSRYVDRQKLNLLETKLQLVQGIR

SEQ ID NO: 5199 - protein, 505 aa, Homo sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 5200 - protein, 227 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 5201 - protein, 747 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 5202 - protein, 119 aa, Homo sapiens
MKLVRFLMKLSHETVTIELKNGTQVHGTITGVDVSMNTHLKAVKMTLKNREPVQLETLSIRGNNIRYFILPDSLPLDTLLVDVEPKVKSKKREAVAGRGRGRGRGRGRGRGRGRGGPRR

SEQ ID NO: 5203 - protein, 184 aa, Homo sapiens
MMGASTLQEPALSPGRCPRQPLRSKFGHQGSTVQRKCSKTNALNVSQKMIEMFVRTKHKIDKSHEFALVVVNDDTAWLSGLTSDPRELCSCLYDLETASCSTFNISGASPARQQKTELPVTENVQTIPPPYVVRTILVYSRPPCQPQFSLTEPMKKMFQCPYFFFDVVYIHNGTEEKEEEMSWK

SEQ ID NO: 5204 - protein, 400 aa, Homo sapiens
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 5205 - protein, 449 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLTVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAVAEAWARLDHKFDLMYAKRAFVHWYVGEGMEEGEFSEAREDMAALEKDYEEVGADSADGEDEGEEY

SEQ ID NO: 5206 - protein, 454 aa, Homo sapiens
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 5207 - protein, 441 aa, Homo sapiens
MKKFFQEFKADIKFKSAGPGQKLKESVGEKAHKEKPNQPAPRPPRQGPTNEAQMAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 5208 - protein, 299 aa, Homo sapiens
MRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRRYHGRCLSPAESPEHPRPGLPPCRARSPL

SEQ ID NO: 5209 - protein, 838 aa, Homo sapiens
MYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 5210 - protein, 198 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 5211 - protein, 459 aa, Homo sapiens
MSVRFSSTSRRLGSCGGTGSVRLSSGGAGFGAGNTCGVPGIGSGFSCAFGGSSSAGGYGGGLGGGSASCAAFTGNEHGLLSGNEKVTMQNLNDRLASYLENVRALEEANADLEQKIKGWYEKFGPGSCRGLDHDYSRYFPIIDELKNQIISATTSNAHVVLQNDNARLTADDFRLKFENELALHQSVEADINGLRRVLDELTLCRTDLEIQLETLSEELAYLKKNHEEEMKALQCAAGGNVNVEMNAAPGVDLTVLLNNMRAEYEALAEQNRRDAEAWFNEKSASLQQQISDDAGATTSARNELIEMKRTLQTLEIELQSLLATKHSLECSLTETESNYCAQLAQIQAQIGALEEQLHQVRTETEGQKLEYEQLLDIKVHLEKEIETYCLLIDGEDGSCSKSKGYGGPGNQTKDSSKTTIVKTVVEEIDPRGKVLSSRVHTVEEKSTKVNNKNEQRVSS

SEQ ID NO: 5212 - protein, 277 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYSWQLGRRVLRLSPRANNPRVALPRVHTGPSSTA

SEQ ID NO: 5213 - protein, 305 aa, Homo sapiens
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRRMLPPPPMWRRSPPRMRRRSRSPRRRSPVRRRSRSPGRRRHRSRSSSNSSR

SEQ ID NO: 5214 - protein, 1065 aa, Homo sapiens
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLSLQGNTVRDDGARSMAEALASNRTLSMLHLQKNSIGPMGAQRMADALKQNRSLKELMFSSNSIGDGGAKALAEALKVNQGLESLDLQSNSISDAGVAALMGALCTNQTLLSLSLRENSISPEGAQAIAHALCANSTLKNLDLTANLLHDQGARAIAVAVRENRTLTSLHLQWNFIQAGAAQALGQALQLNRSLTSLDLQENAIGDDGACAVARALKVNTALTALYLQVASIGASGAQVLGEALAVNRTLEILDLRGNAIGVAGAKALANALKVNSSLRRLNLQENSLGMDGAICIATALSGNHRLQHINLQGNHIGDSGARMISEAIKTNAPTCTVEM

SEQ ID NO: 5215 - protein, 308 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 5216 - protein, 403 aa, Homo sapiens
MAGRRAQTGSAPPRPAAPHPPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVLLDLALQGAGDAEAAVVLEAALATLLTVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 5217 - protein, 297 aa, Homo sapiens
MAELTALESLIEMGFPRGRAEKALALTGNQGIEAAMDWLMEHEDDPDVDEPLETPLGHILGREPTSSEQGGLEGSGSAAGEGKPALSEEERQEQTKRMLELVAQKQREREEREEREALERERQRRRQGQELSAARQRLQEDEMRRAAEERRREKAEELAARQRVREKIERDKAERAKKYGGSVGSQPPPVAPEPGPVPSSPSQEPPTKREYDQCRIQVRLPDGTSLTQTFRAREQLAAVRLYVELHRGEELGGGQDPVQLLSGFPRRAFSEADMERPLQELGLVPSAVLIVAKKCPS

SEQ ID NO: 5218 - protein, 189 aa, Homo sapiens
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 5219 - protein, 1042 aa, Homo sapiens
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAVRIDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 5220 - protein, 370 aa, Homo sapiens [sequence omitted]

SEQ ID NO: 5221 - protein, 478 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 5222 - protein, 745 aa, Homo sapiens
MVGPGPTAAAAVEERQRKLQEYLAAKGKLKSQNTKPYLKSKNNCQNQPPSKSTIRPKNDVTNHVVLPVKPKRSISIKLQPRPPNTAGSQKPKLEPPKLLGKRLTSECVSSNPYSKPSSKSFQQCEAGSSTTGELSRKPVGSLNIEQLKTTKQQLTDQGNGKCIDFMNNIHVENESLDNFLKETNKENLLDILTEPERKPDPKLYTRSKPKTDSYNQTKNSLVPKQALGKSSVNSAVLKDRVNKQFVGETQSRTFPVKSQQLSRGADLARPGVKPSRTVPSHFIRTLSKVQSSKKPVVKNIKDIKVNRSQYERPNETKIRSYPVTEQRVKHTKPRTYPSLLQGEYNNRHPNIKQDQKSSQVCIPQTSCVLQKSKAISQRPNLTVGRFNSAIPSTPSIRPNGTSGNKHNNNGFQQKAQTLDSKLKKAVPQNHFLNKTAPKTQADVTTVNGTQTNPNIKKKATAEDRRKQLEEWQKSKGKTYKRPPMELKTKRKVIKEMNISFWKSIEKEEEEKKAQLELSSKINNTLTECLNLIEGGVPSNEILNILSSIPEAEKFAKFWICKAKLLASKGTFDVIGLYEEAIKNGATPIQELRKVVLNILQDSNRTTEGITSDSLVAETSITSVEELAKKMESVKSCLSPKEREQVTATPRIAKAEQHNYPGIKLQIGPIPRINGMPEVQDMKFITPVRRSSRIERAVSRYPEMLQEHDLVVASLDELLEVEETKCFIFRRNEALPVTLGFQTPES

SEQ ID NO: 5223 - protein, 125 aa, Homo sapiens
MSSTLGKLSNQVEETLPLLKKVPANYFHICSAILMGFSLSKSATQVSAIHMDSKVDDHLIRGTEKSRLEPATQLFQNTKKIRLEDTNQENFTRIEGTGTGSLSGKALGSVVYVKESDGLEMTDVE

SEQ ID NO: 5224 - protein, 1427 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 5225 - protein, 324 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKGVSHRTWPKPDFFRAQFFLESHSCFSNFKNVSTPIKNIYDVIIYAYETDL

SEQ ID NO: 5226 - protein, 89 aa, Homo sapiens
MGTKREAILKVLENLTPEELKKFKMKLGTVPLREGFERIPRGALGQLDIVDLTDKLVASYYEDYAAELVVAVLRDMRMLEEAARLQRAA

SEQ ID NO: 5227 - protein, 288 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGCEAFFDPWPQSMEVAPQRRGLDSSGPRYHRPVCFLCCCSWSLMGLSGFLTGPPPPGMRPPRP

SEQ ID NO: 5228 - protein, 1099 aa, Homo sapiens
MHIKSIILEGFKSYAQRTEVNGFDPLFNAITGLNGSGKSNILDSICFLLGISNLSQVRASNLQDLVYKNGQAGITKASVSITFDNSDKKQSPLGFEVHDEITVTRQVVIGGRNKYLINGVNANNTRVQDLFCSVGLNVNNPHFLIMQGRITKVLNMKPPEILSMIEEAAGTRMYEYKKIAAQKTIEKKEAKLKEIKTILEEEITPTIQKLKEERSSYLEYQKVMREIEHLSRLYIAYQFLLAEDTKVRSAEELKEMQDKVIKLQEELSENDKKIKALNHEIEELEKRKDKETGGILRSLEDALAEAQRVNTKSQSAFDLKKKNLACEESKRKELEKNMVEDSKTLAAKEKEVKKITDGLHALQEASNKDAEALAAAQQHFNAVSAGLSSNEDGAEATLAGQMMACKNDISKAQTEAKQAQMKLKHAQQELKNKQAEVKKMDSGYRKDQEALEAVKRLKEKLEAEMKKLNYEENKEESLLEKRRQLSRDIGRLKETYEALLARFPNLRFAYKDPEKNWNRNCVKGLVASLISVKDTSATTALELVAGERLYNVVVDTEVTGKKLLERGELKRRYTIIPLNKISARCIAPETLRVAQNLVGPDNVHVALSLVEYKPELQKAMEFVFGTTFVCDNMDNAKKVAFDKRIMTRTVTLGGDVFDPHGTLSGGARSQAASILTKFQELKDVQDELRIKENELRALEEELAGLKNTAEKYRQLKQQWEMKTEEADLLQTKLQQSSYHKQQEELDALKKTIEESEETLKNTKEIQRKAEEKYEVLENKMKNAEAERERELKDAQKKLDCAKTKADASSKKMKEKQQEVEAITLELEELKREHTSYKQQLEAVNEAIKSYESQIEVMAAEVAKNKESVNKAQEEVTKQKEVITAQDTVIKAKYAEVAKHKEQNNDSQLKIKELDHNISKHKREAEDGAAKVSKMLKDYDWINAERHLFGQPNSAYDFKTNNPKEAGQRLQKLQEMKEKLGRNVNMRAMNVLTEAEERYNDLMKKKRIVENDKSKILTTIEDLDQKKNQALNIAWQKVNKDFGSIFSTLLPGANAMLAPPEGQTVLDGLEFKVALGNTWKENLTELSGGQRQKQQNHTTG

SEQ ID NO: 5229 - protein, 126 aa, Homo sapiens
MFQKDEYCILILGLDNAGKTTFLEQSKTRFNKNYKGMSLSKITTTVGLNIGTVDVGKARLMFWDLGGQEELQSLWDKDKTKCGDLGTLHSSKVSASFRLRDLAADHHRTQKWQRPDVGTAGWLPLP

SEQ ID NO: 5230 - protein, 372 aa, Homo sapiens
MTFQFNFTIEDHLENELTPIRDGALTLDSSKELSVSESQKGEERDRKCSAEQFDLPQDHLWEHKSMENAAPSQDTDSPLSAASSSRNLEPHGKQPSLRAAKEHAMPKDLKKMLENKVIETLPGFQHVKLSVVKTILLKENFPGENIVSKSFSSHSDLITGVYEGGLKIWECTFDLLAYFTKAKVKFAGKKVLDLGCGSGLLGITAFKGGSKEIHFQDYNSMVIDEVTLPNVVANSTLEDEENDVNEPDVKRCRKPKVTQLYKCRFFSGEWSEFCKLVLSSEKLFVKYDLILTSETIYNPDYYSNLHQTFLRLLSKNGRVLLASKAHYFGVGGGVHLFQKFVEERDVFKTRILKIIDEGLKRFIIEITFKFPG

SEQ ID NO: 5231 - protein, 544 aa, Homo sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKVKYLTFRFIFALRLSKKQKKKKQKPAQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 5232 - protein, 314 aa, Homo sapiens
MPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELREKDRLLAMAVIRKKHGM

SEQ ID NO: 5233 - protein, 214 aa, Homo sapiens
MAGENFATPFHGHVGRGAFSDVYEPAEDTFLLLNALEAAAAELAGVEICLEVGSGSGVVSAFLASMIGPQALYMCTDINPEAAACTLETARCNKVHIQPVITDLVKGLLPRLTEKVDLLVFNPPYVVTPPQEVGSHGIEAAWAGGKNGREVMDRFFPLVPDLLSPKGLFYLVTIKENNPEEILKIMKTKGLQGTTALSRQAGQETLSVLKFTKS

SEQ ID NO: 5234 - protein, 511 aa, Homo sapiens
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 5235 - protein, 327 aa, Homo sapiens
MAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 5236 - protein, 857 aa, Homo sapiens
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 5237 - protein, 550 aa, Homo sapiens
MSQTSLKQKKNEPGMRSSKESLEAEKRKESDKTGVRLSNQGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 5238 - protein, 295 aa, Homo sapiens; identical to SEQ ID NO: 4796

SEQ ID NO: 5239 - protein, 182 aa, Homo sapiens
MSGRSVPHAHPATAEYEFANPSRLGEQRFGEGLLPEEILTPTLYHGYYVRPRAAPAGEGSRAGASELRLSEGKFQAFLDVSHFTPDEVTVRTVDNLLEVSARHPQRLDRHGFVSREFCRTYVLPADVDPWRVRAALSHDGILNLEAPRGGRHLDTEVNEVYISLLPAPPDPEEEEEAAIVEP

SEQ ID NO: 5240 - protein, 211 aa, Homo sapiens
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVLGLVRVPLYTQKDRVGGFPNFLSNAFVSTAKCQLLFALKVLNMMPEEKLVEALAAATEKQKKALEKLLPASS

SEQ ID NO: 5241 - protein, 873 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVREALHVAGVEMQLTAAMSFLTILQDESVSIHAYTHSFLQVILLHLEHRDTGVSNAWLETLLSVIEVLPKETLRHEILNPLVSKAQLSQTVQSRLVSCKILGKLTNKFDAHTIKREILPLVKSLCQDVEYEVRSCMCRQLENIAQGIGTELTKSVVLPELIELSRDEGSSVRLAAFETLVNLLDIFDTDDRSQTILPLVKSFCEKSFKADESILISLSFHLGKLCHGLYGIFTPDQHLRFLEFYKKLCTLGLQQENGHNENQIPPQILEQEKKYISVRKNCAYNFPAMIVFVDPKNFHMELYSTFFCLCHDPEVPVRYTIAICFYEVSKLLNSGVYLIHKELITLLQDESLEVLDALIDHLPEILELMSTGGESSVQENKLSSLPDLIPALTAAEQRAAASLKWRTHEKLLQKYACLPHVISSDQIYYRFLQRMFTIMMTNNVLPVQKAASRTLCIFLRYNRKQEQRHEVIQKLIEQLGQGKSYWNRLRFLDTCEFIIEIFSKSFFCKYFFLPAIELTHDPVANVRMKLCYLLPKVKSTLKIPADKHLLQQLEMCVRKLLCQEKDKDVLAIVKRTVLELDRMEMSMDAFQKKFYEKDLLDQEKEREELLLLEMEQLEKEKQQNDGRPMSDKMFEKKRRDTKTPTQSLPKNIPISVPGPSSVTPSTSKEIKKSKLIRSQSFNNQAFHAKYGNLEKCASKSSTTGYTTSVSGLGKTSVLSLADDSFRTRNASSVPSSFSPNTPLPSTSRGTGNSVDPKSSGSKDTQPRKATLKSRKSNP

SEQ ID NO: 5242 - protein, 316 aa, Homo sapiens
MRQPLSWGRWRAMLARTYGPGPSAGYRWASGAQGYVRNPPVGACDLQGELDRFGGISVRLARLDALDRLDAAAFQKGLQAAVQQWRSEGRTAVWLHIPILQSRFIAPAASLGFCFHHAESDSSTLTLWLREGPSRLPGYASHQVGVAGAVFDESTRKILVVQDRNKLKNMWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 5243 - protein, 178 aa, Homo sapiens
MGETWKNICSTVRHGWWLRDHRMAGLPIPPEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 5244 - protein, 246 aa, Homo sapiens
MAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGKFGVICLEDLIHEIAFPGKHFQEISWFLCPFHLSVARHATKNRVGFLKEMGTPGYRGERINQLIRQLN

SEQ ID NO: 5245 - protein, 813 aa, Homo sapiens
MAWPCITRACCIARFWNQLDKADIAVPLVFTKYSEATEHPGAPPQPPPPQQQAQPALAPPSARAVAIETQPAQGELDAVARATGPAPGPTGEREPAAGPGRSGPGPGLGSGSTSGPADSVMRQDYRAWKVQRPEPSCRPRSEYQPSDAPFERETQYQKDFRAWPLPRRGDHPWIPKPVQISAASQASAPILGAPKRRPQSQERWPVQAAAEAREQEAAPGGAGGLAAGKASGADERDTRRKAGPAWIVRRAEGLGHEQTPLPAAQAQVQATGPEAGRGRAAADALNRQIREEVASAVSSSYRNEFRAWTDIKPVKPIKAKPQYKPPDDKMVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVMIPTAPHTEYIESSP

SEQ ID NO: 5246 - protein, 86 aa, Homo sapiens
MPQYQTWEEFSRAAEKLYLADPMKARVVLKYRHSDGNLCVKVTDDLVCLVYKTDQAQDVKKIEKFHSQLMRLMVAKEARNVTMETE

SEQ ID NO: 5247 - protein, 401 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLKFYYNPNFKRGYPQLLVRVKRRIGVKNASPISTLFNEDFNKKHFRAGANMENHNSALAAEASEESLFSASKNLNMPLTRESSVRQIIANSSVPIRSGFPPPSPSTSVGPSEQIATDQHAILNQLTTIHMHSHSTYMQARGHIVNFITTTTSQYHIISPLQNGYFGLTVEPSAVPTRYPLVSVNEAPYRNMLPAGNPWLQMPTIADRSAAPHSRLALQPSPLDKYHPNYN

SEQ ID NO: 5248 - protein, 1433 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLCYLRYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGFEGCSMVPTIYPLETLHNALSLRQVSEFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 5249 - protein, 378 aa, Homo sapiens
MDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 5250 - protein, 386 aa, Homo sapiens
MCERAARLCRAGAHRLLREPPQQGRALGGLLRWVGARMGEPRESLAPAAPADPGPASPRGGTAVILDIFRRADKNDDGKLSLEEFQLFFADGVLNEKELEDLFHTIDSDNTNHVDTKELCDYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKALWFDLQQRLSDEDGTNMHLQLVRQEMAVCPEQLSEFLDSLRQYLRGTTGVRNCFHITAVRLSDGFTFVIYEFWETEEAWKRHLQSPLCKAFRHVKVDTLSQPEALSRILVPAAWCTVGRD

SEQ ID NO: 5251 - protein, 493 aa, Homo sapiens
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPVQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 5252 - protein, 753 aa, Homo sapiens
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVRAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKNQDNPVIDEIDFLEAFKNIQPSSFRSVIGLMDIKPVDWEEIGGLEDVKLKLKQSIEWPLKFPWEFVRMGLTQPKGVLLYGPPGCAKTTLVRALATSCHCSFVSVSGADLFSPFVGDSEKVLSQIFRQARASTPAILFLDEIDSILGARSASKTGCDVQERVLSVLLNELDGVGLKTIERRGSKSSQQEFQEVFNRSVMIIAATNRPDVLDTALLRPGRLDKIIYIPPPDHKGRLSILKVCTKTMPIGPDVSLENLAAETCFFSGADLRNLCTEAALLALQENGLDATTVKQEHFLKSLKTVKPSLSCKDLALYENLFKKEGFSNVEGI

SEQ ID NO: 5253 - protein, 341 aa, Homo sapiens
MPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRLDRLSGLADQMVARGNLGVYQETRERLAMRLKGLGCQTLGPHNPTPPPSLDMFAEELAEEELETPTPTQRGEAESRGDGLVDVMWEYKWENTGDAELYGPFTSAQMQTWVSEGYFPDGVYCRKLDPPGGQFYNSKRIDFDLYT

SEQ ID NO: 5254 - protein, 229 aa, Homo sapiens
MAEEMESSLEASFSSSGAVSGASGFLPPARSRIFKIIVIGDSNVGKTCLTYRFCAGRFPDRTEATIGVDFRERAVEIDGERIKIQLWDTAGQERFRKSMVQHYYRNVHAVVFVYDMTNMASFHSLPSWIEECKQHLLANDIPRILVGNKCDLRSAIQVPTDLAQKFADTHSMPLFETSAKNPNDNDHVEAIFMTLAHKLKSHKPLMLSQPPDNGIILKPEPKPAMTCWC

SEQ ID NO: 5255 - protein, 783 aa, Homo sapiens
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKEEMRMFRMRVQEVVKENEELHQELNKSSAVTSEEWRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQLQKEEEKERAEMEELMEKLTVLQAQKKSLLLEKNSLTEQNKALEAELERAQKINRKSQKKIEVLKKQVEKAMGNEMSAHQYLANLVGLAENITQERDSLMCLAKCLESEKDGVLNKVIKSNIRLGKLEEKVKGYKKQAALKLGDISHRLLEQQEDFAGKTAQYRQEMRHLHQVLKDKQEVLDQALQQNREMEGELEVIWESTFRENRRIRELLQDTLTRTGVQDNPRALVAPSLNGVSQADLLDGCDVCSYDLKSHAPTC

SEQ ID NO: 5256 - protein, 212 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 5257 - protein, 167 aa, Homo sapiens
MEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNGNAQ

SEQ ID NO: 5258 - protein, 126 aa, Homo sapiens
MAAGPEPPEWEPRWRKALRGKENKGSVEIMRKDLNDARDLHGQAESAAAVWKGHVMDRRKKALTDYKKLRAFFVEEEEHFLQEAEKEEGLPEDELADPTERFRSLLQAVSELEKKHRNLGLSMLLQ

SEQ ID NO: 5259 - protein, 555 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 5260 - protein, 1050 aa, Homo sapiens
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSASSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIPLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 5261 - protein, 553 aa, Homo sapiens
MDVDKELGMESVKAGASGKPEMRLGTQEETSEGDANESSLLVLSSNVPLLALEFLEIAQAKEKAFLPMVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 5262 - protein, 755 aa, Homo sapiens
MVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQEVLGQLRAHVEAAEEAARERLAELEGREQVARAAAAFARRVLSLGREAEILSLEGAIAQRLRQLQGCPWAPGPAPCLLPQLELHPGLLDKNCHLLRLSFEEQQPQKDGGKDGAGTQGGEESQSRREDEPKTERQGGVQPQAGDGAQTPKEEKAQTTREEGAQTLEEDRAQTPHEDGGPQPHRGGRPNKKKKFKGRLKSISREPSPALGPNLDGSGLLPRPIFYCSFPTRMPGDKRSPRITGLCPFGPREILVADEQNRALKRFSLNGDYKGTVPVPEGCSPCSVAALQSAVAFSASARLYLINPNGEVQWRRALSLSQASHAVAALPSGDRVAVSVAGHVEVYNMEGSLATRFIPGGKASRGLRALVFLTTSPQGHFVGSDWQQNSVVICDGLGQVVGEYKGPGLHGCQPGSVSVDKKGYIFLTLREVNKVVILDPKGSLLGDFLTAYHGLEKPRVTTMVDGRYLVVSLSNGTIHIFRVRSPDS

SEQ ID NO: 5263 - protein, 488 aa, Homo sapiens
MAAGSEATTPVIVAAGAGGEEGEHVKPFKPEKAKEIIMSLQQPAIFCNMVFDWPARHWNAKYLSQVLHGKQIRFRMGMKSMSTVPQFETTCNYVEATLEEFLTWNCDQSSISGPFRDYDHSKFWAYADYKYFVSLFEDKTDLFQDVKWSDFGFPGRNGQESTLWIGSLGAHTPCHLDSYGCNLVFQVQGRKRWHLFPPEDTPFLYPTRIPYEESSVFSKINVVNPDLKRFPQFRKAQRHAVTLSPGQVLFVPRHWWHYVESIDPVTVSINSWIELEEDHLARVEEAITRMLVCALKTAENPQNTRAWLNPTEVEETSHAVNCCYLNAAVSAFFDRCRTSEVVEIQALRTDGEHMKKEELNVCNHMEVGQTGSQNLTTGTDKPEAASPFGPDLVPVAQRSEEPPSERGGIFGSDGKDFVDKDGEHFGKLHCAKRQQIMSNSENAIEEQIASNTTTTPQTFISTDDLLDCLVNPQVTRIVAQLLIQGRSL

SEQ ID NO: 5264 - protein, 192 aa, Homo sapiens
MAPKPGAEWSTALSHLVLGVVSLHAAVSTAEASRGAAAGFLLQVLAATTTLAPGLSTHEDCLAGAWVATVIGLPLLAFDFHWVNGDRSSANLLLGGGMVLAVAGGHLGPEGRSVAGQAMLLVVAVTILIVAVFTANTYGMWGGAMLGVAGLLSRLEEDRLLLLPKEDVCRWALAVGSWAYCRALHTQRLQWE

SEQ ID NO: 5265 - protein, 153 aa, Homo sapiens
MTSESTSPPVVPPLHSPKSPVWPTFPFHREGSRVWERGGVPPRDLPSPLPTKRTRTYSATARASAGPVFKGVCKQFSRSQGHGFITPENGSEDIFVHVSDIEGEYVPVEGDEVTYKMCPIPPKNQKFQAVEVVLTQLAPHTPHETWSGQVVGS

SEQ ID NO: 5266 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 5267 - protein, 2920 aa, Homo sapiens
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 5268 - protein, 129 aa, Homo sapiens
MADPRVRQIKIKTGVVKRLVKEKVMYEKEAKQQEEKIEKMRAEDGENYDIKKQAEILQESRMMIPDCQRRLEAAYLDLQRILVSKDFCVMFKFFFSIQYMESQKFKYLTLRTSWQYFLFTCPLYRYILK

SEQ ID NO: 5269 - protein, 193 aa, Homo sapiens
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 5270 - protein, 464 aa, Homo sapiens
MSLQFSNGSRHVCLRSGAGSVRPLNGGAGFAGSSACGGSVAGSEFSCALGGGLGSVPGGSHAGGALGNAACIGFAGSEGGLLSGNEKVTMQNLNDRLASYLDNVRALEEANAELERKIKGWYEKYGPGSCRGLDHDYSRYHLTIEDLKNKIISSTTTNANVILQIDNARLAADDFRLKYENELTLHQNVEADINGLRRVLDELTLCRTDQELQYESLSEEMTYLKKNHEEEMKALQCAAGGNVNVEMNAAPGVDLAVLLNNMRAEYEALAEQNRKDAEAWFNEKSASLQQQISHDSGAATFARSQLTEMRRTLQTLEIQLQSLMATKHSLECSLTETESNYCTQLAQIQAQIGALEEQLHQVRTETEGQKLEYEHLLDVKVHLEKEIETYCRLIDGDGNSCSKSKGFGSGSPGNSSKDLSKTTLVKTVVEELDQRGKVLSSRIHSIEEKTSKMTNGKTEQRVPF

SEQ ID NO: 5271 - protein, 670 aa, Homo sapiens
MEEFRRSYSRLCRESGAEPQEAVLQQLHQLPRGRLDLATQSLTVETCRALGKLLPRETLCTELVLSDCMLSEEGATLLLRGLCANTVLRFLDLKGNNLRAAGAEALGKLLQQNKSIQSLTLEWNSLGTWDDAFATFCGGLAANGALQRLDLRNNQISHKGAEELALALKGNTTLQQLDLRWNNVGLLGGRALMNCLPSNRTLWRLDLAGNNIPGDVLRAVEQAMGHSQDRLTTFQENQARTHVLSKEVQHLREEKSKQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 5272 - protein, 593 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 5273 - protein, 627 aa, Homo sapiens
MEGLAGYVYKAASEGKVLTLAALLLNRSESDIRYLLGYVSQQGGQRSTPLIIAARNGHAKVVRLLLEHYRVQTQQTGTVRFDGYVIDGATALWCAAGAGHFEVVKLLVSHGANVNHTTVTNSTPLRAACFDGRLDIVKYLVENNANISIANKYDNTCLMIAAYKGHTDVVRYLLEQRADPNAKAHCGATALHFAAEAGHIDIVKELIKWRAAIVVNGHGMTPLKVAAESCKADVVELLLSHADCDRRSRIEALELLGASFANDRENYDIIKTYHYLYLAMLERFQDGDNILEKEVLPPIHAYGNRTECRNPQELESIRQDRDALHMEGLIVRERILGADNIDVSHPIIYRGAVYADNMEFEQCIKLWLHALHLRQKGNRNTHKDLLRFAQVFSQMIHLNETVKAPDIECVLRCSVLEIEQSMNRVKNISDADVHNAMDNYECNLYTFLYLVCISTKTQCSEEDQCKINKQIYNLIHLDPRTREGFTLLHLAVNSNTPVDDFHTNDVCSFPNALVTKLLLDCGAEVNAVDNEGNSALHIIVQYNRPISDFLTLHSIIISLVEAGAHTDMTNKQNKTPLDKSTTGVSEILLKTQMKMSLKCLAARAVRANDINYQDQIPRTLEEFVGFH

SEQ ID NO: 5274 - protein, 125 aa, Homo sapiens
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVCASQETFGMKLSV

SEQ ID NO: 5275 - protein, 1261 aa, Homo sapiens
MGTGDFICISMTGGAPWGFRLQGGKEQKQPLQVAKIRNQSKASGSGLCEGDEVVSINGNPCADLTYPEVIKLMESITDSLQMLIKRPSSGISEALISENENKNLEHLTHGGYVESTTLQIRPATKTQCTEFFLAPVKTEVPLAENQRSGPDCAGSLKEETGPSYQRAPQMPDSQRGRVAEELILREKVEAVQPGPVVELQLSLSQERHKGASGPLVALPGAEKSKSPDPDPNLSHDRIVHINSIPTNEKADPFLRSSKIIQISSGRELRVIQESEAGDAGLPRVEVILDCSDRQKTEGCRLQAGKECVDSPVEGGQSEAPPSLVSFAVSSEGTEQGEDPRSEKDHSRPHKHRARHARLRRSESLSEKQVKEAKSKCKSIALLLTDAPNPNSKGVLMFKKRRRRARKYTLVSYGTGELEREADEEEEGDKEDTCEVAFLGASESEVDEELLSDVDDNTQVVNFDWDSGLVDIEKKLNRGDKMEMLPDTTGKGALMFAKRRERMDQITAQKEEDKVGGTPSREQDAAQTDGLRTTTSYQRKEEESVRTQSSVSKSYIEVSHGLGHVPQQNGFSGTSETANIQRMVPMNRTAKPFPGSVNQPATPFSPTRNMTSPIADFPAPPPYSAVTPPPDAFSRGVSSPIAGPAQPPPWPQPAPWSQPAFYDSSERIASRDERISVPAKRTGILQEAKRRSTTKPMFTFKEPKVSPNPELLSLLQNSEGKRGTGAGGDSGPEEDYLSLGAEACNFMQSSSAKQKTPPPVAPKPAVKSSSSQPVTPVSPVWSPGVAPTQPPAFPTSNPSKGTVVSSIKIAQPSYPPARPASTLNVAGPFKGPQAAVASQNYTPKPTVSTPTVNAVQPGAVGPSNELPGMSGRGAQLFAKRQSRMEKYVVDSDTVQAHAARAQSPTPSLPASWKYSSNVRAPPPVAYNPIHSPSYPLAALKSQPSAAQPSKMGKKKGKKPLNALDVMKHQPYQLNASLFTFQPPDAKDGLPQKSSVKVNSALAMKQALPPRPVNAASPTNVQASSVYSVPAYTSPPSFFAEASSPVSASPVPVGIPTSPKQESASSSYFVAPRPKFSAKKSGVTIQESGRSLSLPGRSVPPPISTSPWVYQPTYSYSSKPTDGLEKANKRPTPWEAAAKSPLGLVDDAFQPRNIQESIVANVVSAARRKVLPGPPEDWNERLSYIPQTQKAYMGSCGRQEYNVTANNNMSTTSQYGSQLPYAYYRQASRNDSAIMSMETRSDYCLPVADYNYNPHPRGWRRQT

SEQ ID NO: 5276 - protein, 381 aa, Homo sapiens
MSWTVPVVRASQRVSSVGANFLCLGMALCPRQATRIPLNGTWLFTPVSKMATVKSELIERFTSEKPVHHSKVSIIGTGSVGMACAISILLKGLSDELALVDLDEDKLKGETMDLQHGSPFTKMPNIVCSKDYFVTANSNLVIITAGARQEKGETRLNLVQRNVAIFKLMISSIVQYSPHCKLIIVSNPVDILTYVAWKLSAFPKNRIIGSGCNLDTARFRFLIGQKLGIHSESCHGWILGEHGDSSVPVWSGVNIAGVPLKDLNSDIGTDKDPEQWKNVHKEVTATAYEIIKMKGYTSWAIGLSVADLTESILKNLRRIHPVSTIIKGLYGIDEEVFLSIPCILGENGITNLIKIKLTPEEEAHLKKSAKTLWEIQNKLKL

SEQ ID NO: 5277 - protein, 286 aa, Homo sapiens
MMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTTQFLMNDRDPEEPNLDVPHGISHPGSSGESEAGDSDGRGRAHGEFQRKDFSETYERFHTESLQGRSKQELVRDYLELEKRLSQAEEETRRLQQLQACTGQQSCRQVEELAAEVQRLRTENQRLRQENQMWNREGCRCDEEPGT

SEQ ID NO: 5278 - protein, 401 aa, Homo sapiens; identical to SEQ ID NO: 5247

SEQ ID NO: 5279 - protein, 575 aa, Homo sapiens
MAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGATPKPEPEPEQVIKNYTEELKVPPDEDCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 5280 - protein, 364 aa, Homo sapiens
MEHNGSASNADKIHQNRLSSVTEDEDQDAALTIVTVLDKVASIVDSVQASQKRIEERHREMENAIKSVQIDLLKLSQSHSNTGHIINKLFEKTRKVSAHIKDVKARVEKQQIHVKKVEVKQEEIMKKNKFRVVIFQEKFRCPTSLSVVKDRNLTENQEEDDDDIFDPPVDLSSDEEYYVEESRSARLRKSGKEHIDNIKKAFSKENMQKTRQNLDKKVNRIRTRIVTPERRERLRQSGERLRQSGERLRQSGERFKKSISNAAPSKEAFKMRSLRKGKDRTVAEGEECAREMGVDIIARSESLGPISELYSDELSEPEHEAARPVYPPHEGREIPTPEPLKVTFKSQVKVEDDESLLLDLKHSS

SEQ ID NO: 5281 - protein, 421 aa, Homo sapiens
MPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSDLEEDTRILQYFVSQGFEFFCSQSLSKNFGIYDEGVGMLVVVAVNNQQLLCVLSQLEGLAQALWLNPPNTGARVITSILCNPALLGEWKQSLKEVVENIMLTKEKVKEKLQLLGTPGSWGHITEQSGTHGYLGLNSQQVEYLVRKKHIYIPKNGQINFSCINANNINYITEGINEAVLLTESSEMCLPKEKKTLIGIKL

SEQ ID NO: 5282 - protein, 191 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 5283 - protein, 1068 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 5284 - protein, 450 aa, Homo sapiens
MSCLMVERCGEILFENPDQNAKCVCMLGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 5285 - protein, 755 aa, Homo sapiens
MAGCIPEEKTYRRFLELFLGEFRGPCGGGEPEPEPEPEPEPEPESEPEPEPELVEAEAAEASVEEPGEEAATVAATEEGDQEQDPEPEEEAAVEGEEEEEGAATAAAAPGHSAVPPPPPQLPPLPPLPRPLSERITREEVEGESLDLCLQQLYKYNCPSFLAAALARATSDEVLQSDLSAHYIPKETDGTEGTVEIETVKLARSVFSKLHEICCSWVKDFPLRRRPQLYYETSIHAIKNMRRKMEDKHVCIPDFNMLFNLEDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 5286 - protein, 256 aa, Homo sapiens
MASRYDRAITVFSPDGHLFQVEYAQEAVKKGSTAVGIRGTNIVVLGVEKKSVAKLQDERTVRKICALDDHVCMAFAVLTIFIGLTADARVVINRARVECQSHKLTVEDPVTVEYITRFIATLKQKYTQSNGRRPFGISALIVGFDDDGISRLYQTDPSGTYHAWKANAIGRSAKTVREFLEKNYTEDAIASDSEAIKLAIKALLEVVQSGGKNIELAIIRRNQPLKMFSAKEVELYVTEIEKEKEEAEKKKSKKSV

SEQ ID NO: 5287 - protein, 1035 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 5288 - protein, 793 aa, Homo sapiens
MLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRAGWSDSSQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 5289 - protein, 360 aa, Homo sapiens
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVDGLLFYHKQTHYSPGSTPLVGWLRPYMVSDVLGVAVPAGPLTTKPDYAGHQLQQIMEHKKSQKEGMKEKLTHKASENGHYELEHLSTPKLKGSSHSPDHPGCLMEN

SEQ ID NO: 5290 - protein, 174 aa, Homo sapiens
LIHKPLKRAITTLMAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRIKPLKLPQGLPAEENMSNTCLKSTGELVVQWHLKPVEQKAHES

SEQ ID NO: 5291 - protein, 477 aa, Homo sapiens
MATYTCITCRVAFRDADMQRAHYKTDWHRYNLRRKVASMAPVTAEGFQERVRAQRAVAEEESKGSATYCTVCSKKFASFNAYENHLKSRRHVELEKKAVQAVNRKVEMMNEKNLEKGLGVDSVDKDAMNAAIQQAIKAQPSMSPKKAPPAPAKEARNVVAVGTGGRGTHDRDPSEKPPRLQWFEQQAKKLAKQQEEDSEEEEEDLDGDDWEDIDSDEELECEDTEAMDDVVEQDAEEEEAEEGPPLGAIPITDCLFCSHHSSSLMKNVAHMTKDHSFFIPDIEYLSDIKGLIKYLGEKVGVGKICLWCNEKGKSFYSTEAVQAHMNDKSHCKLFTDGDAALEFADFYDFRSSYPDHKEGEDPNKAEELPSEKNLEYDDETMELILPSGARVGHRSLMRYYKQRFGLSRAVAVAKNRKAVGRVLQQYRALGWTGSTGAALMRERDMQYVQRMKSKWMLKTGMKNNATKQMHFRVQVRF

SEQ ID NO: 5292 - protein, 953 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 5293 - protein, 327 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKLKKDKALMGHFQDGLSYSVFKTITDQVLMGVDPRGESEVKAQGFKAALVIDVTAKLTAIDNHPMNRVLGFGTKYLKENFSPWIQQHGGWEKILGISHEEVD

SEQ ID NO: 5294 - protein, 361 aa, Homo sapiens
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 5295 - protein, 259 aa, Homo sapiens
MKDVDNLKSIKEEWVCETGSDNQPLGNNQQSNCEYFVDSLFEEAQKVSSKCVSPAEQKKQVDVNIKLWKNGFTVNDDFRSYSDGASQQFLNSIKKGELPSELQGIFDKEEVDVKVEDKKNEICLSTKPVFQPFSGQGHRLGSATPKIVSKAKNIEVENKNNLSAVPLNNLEPITNIQIWLANGKRIVQKFNITHRVSHIKDFIEKYQGSQRSPPFSLATALPVLRLLDETLTLEEADLQNAVIIQRLQKTASFRELSEH

SEQ ID NO: 5296 - protein, 329 aa, Homo sapiens
MVRTKTWTLKKHFVGYPTNSDFELKTAELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLEGKIQYKEYIIEGFENMPAAFMGMLKGDNLGKTIVKA

SEQ ID NO: 5297 - protein, 1001 aa, Homo sapiens
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 5298 - protein, 216 aa, Homo sapiens
MSFLFGSRSSKTFKPKKNIPEGSHQYELLKHAEATLGSGNLRMAVMLPEGEDLNEWVAVNTVDFFNQINMLYGTITDFCTEESCPVMSAGPKYEYHWADGTNIKKPIKCSAPKYIDYLMTWVQDQLDDETLFPSKIGVPFPKNFMSVAKTILKRLFRVYAHIYHQHFDPVIQLQEEAHLNTSFKHFIFFVQEFNLIDRRELAPLQELIEKLTSKDR

SEQ ID NO: 5299 - protein, 158 aa, Homo sapiens
MAAQGVGPGPGSAAPPGLEAARQKLALRRKKVLSTEEMELYELAQAAGGGIDPDVFKILVDLLKLNVAPLAVFQMLKSMCAGQRLASEPQDPAAVSLPTSSVPETRGRDKGSAALGGVLALAERSNHEGSSQRMPRQPSATRLPKGGGPGKSPTQGST

SEQ ID NO: 5300 - protein, 474 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 5301 - protein, 314 aa, Homo sapiens
MAFVTRQFMRSVSSSSTASASAKKIIVKHVTVIGGGLMGAGIAQVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 5302 - protein, 269 aa, Homo sapiens
MGNCCWTQCFGLLRKEAGRLQRVGGGGGSKYFRTCSRGEHLTIEFENLVESDEGESPGSSHRPLTEEEIVDLRERHYDSIAEKQKDLDKKIQKEQERQRIVQQYHPSNNGEYQSSGPEDDFESCLRNMKSQYEVFRSSRLSSDATVLTPNTESSCDLMTKTKSTSGNDDSTSLDLEWEDEEGMNRMLPMRERSKTEEDILRAALKYSNKKTGSNPTSASDDSNGLEWENDFVSAEMDDNGNSEYSGFVNPVLELSDSGIRHSDTDQQTR

SEQ ID NO: 5303 - protein, 456 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 5304 - protein, 203 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKIRFTKMKLSRSSTYENRYLCCNLHLKDESNYS

SEQ ID NO: 5305 - protein, 683 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSGPESGRSSPYHSQLDVRSSTPTSYQAPKHFHIPAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 5306 - protein, 846 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 5307 - protein, 551 aa, Homo sapiens
MGRKAIVLAIANTSLAFPLCQHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEALQDKEKVSELEAVMEKQKKKVEGEVEMEVI

SEQ ID NO: 5308 - protein, 562 aa, Homo sapiens
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 5309 - protein, 683 aa, Homo sapiens
MAAAVAAPLAAGGEEAAATTSVPGSPGLPGRRSAERALEEAVATGTLNLSNRRLKHFPRGAARSYDLSDITQADLSRNRFPEVPEAACQLVSLEGLSLYHNCLRCLNPALGNLTALTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPCPAEDLFPGHRYDGGLDSGFHSVDSGSKRWSGNESTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 5310 - protein, 100 aa, Homo sapiens
MSTSTSCPIPGGRDQLPDCYSTTPGGTLYATTPGGTRIIYDRKFLLECKNSPIARTPPCCLPQIPGVTTPPTAPLSKLEELKEQETEEEIPDDAQFEMDI

SEQ ID NO: 5311 - protein, 793 aa, Homo sapiens
MPMESASSDNKKQIPNEASARSERDTSDLEQNWSLQDHYRMYSPIIYQALCEHVQTQMSLMNDLTSKNIPNGIPAVPCHAPSHSESQATPHSSYGLCTSTPVWSLQRPPCPPKVHSEVQTDGNSQFASQGKTVSATCTDVLRNSFNTSPGVPCSLPKTDISAIPTLQQLGLVNGILPQQGIHKETDLLKCIQTYLSLFRSHGKETHLDSQTHRSPTQSQPAFLATNEEKCAREQIREATSERKDLNIHVRDTKTVKDVQKAKNVNKTAEKVRIIKYLLGELKALVAEQEDSEIQRLITEMEACISVLPTVSGNTDIQVEIALAMQPLRSENAQLRRQLRILNQQLREQQKTQKPSGAVDCNLELFSLQSLNMSLQNQLEESLKSQELLQSKNEELLKVIENQKDENKKFSSIFKDKDQTILENKQQYDIEITRIKIELEEALVNVKSSQFKLETAEKENQILGITLRQRDAEVTRLRELTRTLQTSMAKLLSDLSVDSARCKPGNNLTKSLLNIHDKQLQHDPAPAHTSIMSYLNKLETNYSFTHSEPLSTIKNEETIEPDKTYENVLSSRGPQNSNTRGMEEASAPGIISALSKQDSDEGSETMALIEDEHNLDNTIYIPFARSTPEKKSPLSKRLSPQPQIRAATTQLVSNSGLAVSGKENKLCTPVICSSSTKEAEDAPEKLSRASDMKDTQLLKKIKEAIGKIPAATKEPEEQTACHGPSGCLSNSLQVKGNTVCDGSVFTSDLMSDWSISSFSTFTSRDEQDFRNGLAALDANIARLQKSLRTGLLEK

SEQ ID NO: 5312 - protein, 372 aa, Homo sapiens; identical to SEQ ID NO: 5230

SEQ ID NO: 5313 - protein, 111 aa, Homo sapiens
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERYEESTFQGY

SEQ ID NO: 5314 - protein, 482 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 5315 - protein, 448 aa, Homo sapiens
MSPLECSECFGDQLLHRTYTWQLTLHSRPNYTRKRDTRSESLEIPISVVLPQRGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENRMLSKENKILQVFWEEHKASLGREESRAPSPLLHKDSASLEVVKKDHVALQVPRGKEDSTLQLLREENRALQQLLEQKQAYWAQAEDTAAPAEESKPAPSPHEEPCSPGLLQDQGSGLSSRFEEPKGPPARQEDSKELRALRKMVSNMSGPSGEEEAKVGPGLPDGCQPLQLLREMRQALQALLKENRLLQEENRTLQVLRAEHRGFQEENKALWENNKLKLQQKLVIDTVTEVTARMEMLIEELYAFMPARSQDPKKPSRV

SEQ ID NO: 5316 - protein, 333 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 5317 - protein, 342 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 5318 - protein, 168 aa, Homo sapiens
MAEGSRIPQARALLQQCLHARLQIRPADGDVAAQWVEVQRGLVIYVCFFKGADKELLPKMVNTLLNVKLSETENGKHVSILDLPGNILIIPQATLGGRLKGRNMQYHSNSGKEEGFELYSQFVTLCEKEVAANSKCAEARVVVEHGTYGNRQVLKLDTNGPFTHLIEF

SEQ ID NO: 5319 - protein, 1022 aa, Homo sapiens
MEGALTARDKVGVQDFVLLDAYTSESAFVDNLRKRFSENLIYTYIGTLLVSVNPYQELGIYTVSQMELYQGVNFFELPPHVYAIADNAYRMMCAELNNHFILISGESGAGKTEASKKILEYFAVTCPMTQSLQIARDRLLFSNPVLEAFGNARTLRNDNSSRFGKYMDIQFDFQGIPVGGHIISYLIEKSRVVYQNEGERNFHIFYQLLAGGEEERLSYLGLERDPQLYKYLSQGHCAKESSISDKNDWKTVSNAFSVIDFTEADLENLFGIIASVLHLGNIGFEEDDQGCATIPDTHEIKWIAKLLGVHPSVLLEALTHRKIEAKTEEVICPLTLELSVYARDAMAKAVYGRTFTWLVNKINSSLVNKDFTRKTVIGLLDIYGFEVFDKNGFEQFCINYCNEKLQQLLIERTLKAEQAEYEMEGIEWEPIKYFNNKIICDLVEERHKGIISILDEECIRPGPATDLSFLEKLEEKVGKHAHFETRKLAGPKGRKRIGWMEFRLLHYAGEVTYCTKGFLEKNNDLLYRHLKEVLCKSKNIILRECFLLAELENRRRPPTVGTQFKNSLSSLLETLISKEPSYIRCIKPNDRKEPSKFDDFLIRHQIKYLGLMEHLRVRRAGFAYRRKYEHFLQRYKSLCPDTWPHWHGPPAEGVERLIKYIGYKPEEYKLGKTKIFIRFPRTLFATEDAFEFSKHQLVARIQATYKRCLGRREYVKKRQAAIKLEAHWRGALARKAIQRRKWAVRIIRKFIKGFISRNKPLCPDNEEFIVFVRKNYILNLRYHLPKTVLDKSWLRPPGILENASDLLRKMCVRNLVQKYCRGITAERKAMMQQKVVTSEIFRGRKDGYTESLNQPFVNSRIDEGDINPKVLQLISHEKIQYGVPVIKYDRKGFKARQRQLILTQKAAYVVELAKIKQKIEYSALKGVSTSNLSDGILVIHVSPEDSKQKGDAVLQCGHVFEAVTKLVMLVKKENIVNVVQGSLQFFISPGKEGTIVFDTGLEEQVYKNKNGQLTVVSVRRKS

SEQ ID NO: 5320 - protein, 347 aa, Homo sapiens
MNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEARSLRADSPCW

SEQ ID NO: 5321 - protein, 147 aa, Homo sapiens
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 5322 - protein, 185 aa, Homo sapiens
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQSGMLEAGVDRIISQVVDPKLNHIFRPQIERAIHEFLAAQKKAAVPAPPPEPEGQDPPAPSQDTS

SEQ ID NO: 5323 - protein, 2116 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 5324 - protein, 887 aa, Homo sapiens
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 5325 - protein, 647 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 5326 - protein, 357 aa, Homo sapiens
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAAPSGEFRAGDLCCDLGKSFQVFGPPPPCL

SEQ ID NO: 5327 - protein, 283 aa, Homo sapiens
MLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVVLGVGKQGRLVRSIPWAPRPSSWCAAVLGAAVVMCGTP

SEQ ID NO: 5328 - protein, 719 aa, Homo sapiens
MGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 5329 - protein, 377 aa, Homo sapiens
MEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKSLELIRKHGFSVALFAPGCSVFPGVGNLLCC

SEQ ID NO: 5330 - protein, 308 aa, Homo sapiens
MRGKRRPQTRAARRLAAQESSEAEDMSVPRGPIAQWADGAISPNGHRPQLRAASGEDSTEEALAAAAAPWEGGPVPGVDTSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSSSQQDVILTTQDIFEDDIFATEAIKPSQKTREKEKTLESNLFDDNIDIFADLTVKPKEKSKKKVEAKSIFDDDMDDIFSTGIQAKTTKPKSRSAQAAPEPRFEHKVSNIFDDPLNAFGGQ

SEQ ID NO: 5331 - protein, 310 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQNETSACFEDPCLGAHGSHFSLSNFLL

SEQ ID NO: 5332 - protein, 372 aa, Homo sapiens
MRVGPVRSAMSGASQPRGPALLFPATRGVPAKRLLDADDAAAVAAKCPRLSECSSPPDYLSPPGSPCSPQPPPAAPGAGGGSGSAPGPSRIADYLLLPLAEREHVSRALCIHTGRELRCKVFPIKHYQDKIRPYIQLPSHSNITGIVEVILGETKAYVFFEKDFGDMHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 5333 - protein, 517 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLSSSRLSYQPAALGVGSADLAYPVVFAAGLNATHPHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 5334 - protein, 495 aa, Homo sapiens
MWRGCARSRKRKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 5335 - protein, 485 aa, Homo sapiens
MCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSQMQSPIPLTETRTPPGPCCSPGVGWAQRCGQGACRREDPQACIEEQLCYSCRVNMKDLGLGLAGDPGLSD

SEQ ID NO: 5336 - protein, 450 aa, Homo sapiens
MSLRLSSASRRSCPRPTTGSLRLYGGGTSFGTGNSCGISGIGSGFSSAFGGSSSGGNTGGGNPCAGFTVNERGLLSGNEKVTMQNLNDRLASYLDSVHALEEANADLEQKIKGWYEKFGPGSCRGLDHDYSRYFPIIDDLKNQIIASTTSNANAVLQIDNARLTADDFRLKYENELALHQSVEADVNGLRRVLDEITLCRTDLEIQYETLSEEMTYLKKNHKEEMQVLQCAAGGNVNVEMNAAPGVDLTVLLNNMRAEYEALAEQNRRDAEAWFNEKSASLQQQISEDVGATTSARNELTEMKRTLQTLEIELQSLLATKHSLECSLTETESNYCAQLAQIQAQIGALEEQLHQVRTETEGQKLEYEQLLDIKLHLEKEIETYCLLIGGDDGACKSGGYKSKDYGSGNVGSQVKDPAKAIVVKKVLEEVDQRSKILTTRLHSLEEKSQSN

SEQ ID NO: 5337 - protein, 892 aa, Homo sapiens
MDQPEAPCSSTGPRLAVARELLLAALEELSQEQLKRFRHKLRDVGPDGRSIPWGRLERADAVDLAEQLAQFYGPEPALEVARKTLKRADARDVAAQLQERRLQRLGLGSGTLLSVSEYKKKYREHVLQLHARVKERNARSVKITKRFTKLLIAPESAAPEEAMGPAEEPEPGRARRSDTHTFNRLFRRDEEGRRPLTVVLQGPAGIGKTMAAKKILYDWAAGKLYQGQVDFAFFMPCGELLERPGTRSLADLILDQCPDRGAPVPQMLAQPQRLLFILDGADELPALGGPEAAPCTDPFEAASGARVLGGLLSKALLPTALLLVTTRAAAPGRLQGRLCSPQCAEVRGFSDKDKKKYFYKYFRDERRAERAYRFVKENETLFALCFVPFVCWIVCTVLRQQLELGRDLSRTSKTTTSVYLLFITSVLSSAPVADGPRLQGDLRNLCRLAREGVLGRRAQFAEKELEQLELRGSKVQTLFLSKKELPGVLETEVTYQFIDQSFQEFLAALSYLLEDGGVPRTAAGGVGTLLRGDAQPHSHLVLTTRFLFGLLSAERMRDIERHFGCMVSERVKQEALRWVQGQGQGCPGVAPEVTEGAKGLEDTEEPEEEEEGEEPNYPLELLYCLYETQEDAFVRQALCRFPELALQRVRFCRMDVAVLSYCVRCCPAGQALRLISCRLVAAQEKKKKSLGKRLQASLGGGSSSQGTTKQLPASLLHPLFQAMTDPLCHLSSLTLSHCKLPDAVCRDLSEALRAAPALTELGLLHNRLSEAGLRMLSEGLAWPQCRVQTVRVQLPDPQRGLQYLVGMLRQSPALTTLDLSGCQLPAPMVTYLCAVLQHQGCGLQTLSLASVELSEQSLQELQAVKRAKPDLVITHPALDGHPQPPKELISTF

SEQ ID NO: 5338 - protein, 348 aa, Homo sapiens
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 5339 - protein, 632 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKTVIKPESCVPCGKRIKFGKLSLKCRDCRVVSHPECRDRCPLPCIPTLIGTPVKIGEGMLADFVSQTSPMIPSIVVHCVNEIEQRGLTETGLYRISGCDRTVKELKEKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMMVEQENIDPLHVIENSNAFSTPQTPDIKVSLLGPVTTPEHQLLKTPSSSSLSQRVRSTLTKNTPRFGSKSKSATNLGRQGNFFASPMLK

SEQ ID NO: 5340 - protein, 4024 aa, Homo sapiens
MSSEQDKSASKEKSKKPVRFLPQLSMEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIMQQDADLDSAVPDGSTIPKPTASAIEKDILRYYYYIHHGIDTDHVAPMEDSWLEHVLDLVPQHLKVFTDSIVTLSDEMREDYLLSVRKSIVDFVLKDPREKGDDKKTDELPAHRAEMEILPKPWRKSFLAASSYIRDHLNAMNPTMLAVLDLWHTNFKKLRLVDIKEFHNCQDALELSSFQNIIMRHMDSAKETLLKMWFPEVQNIYYQGNKKKQLPTGDSSAKLESFFNCAAALMTLQLQDLTLVSMQDFTDLIAQPPDSVRAFEHPGFIMRLILDNDTIKFEPELSDYIDIFLNVYDVMIKAVSFVPRVETKLYSKWESKSKPTTLKPIILNEIVDAHKEKIKEVIMKESVAPTEHLRLYDKYDFLITRKAERDVDNFLAENHSYEKIIDEICKYQKLIEEIQYTSIKTIRLGMFEMHCEELIRALVKRADIICGKLLAKMFRDHQEVNTRLCDEFERIAEKALSTPPNTAELMEMKAYIQKVEVTDMIELEQRLVDSKNCLAFLIEYVNFSPADMRLNNSVFQWYGRMGEIFEEHRKIIKEKIEQYQEGLKLRCERFVEELESYAKQSEEFYSFGDLQDVQRYLKKAQILNGKLDLAADKIEQFNAEEEAFGWLPSVYPQRKKIQDGLNPYLRLYETAVEFSSNYRAWTEGPYHKVNPDQVEADIGNYWRGLYKLEKTFHDSPYALAMTKKVRSKVEDFKQHIPLIQVICNPGLRPRHWEAMSAIVGYPLQPSDDSTVSSFLDMNLEPYIDRFEGISEAASKEYSLEKAMEKMITEWDAVEFVIHSYRETGTFILASVDEIQMLLDDHIIKTQTMRGSPFIKPYEKQMREWEGKLLLLQEILDEWLKVQATWLYLEPIFSSPDIMSQMPEEGRRFTAVDKTWRDIMRSVMQDKHVLTVVTIDRMLERLKKSNELLELILKGLNEYLEKKRLFFPRFFFLSNDELLEILSETKDPTRVQPHLKKCFEGIAKVEFTETLDITHMKSSEGEVVELIEIISTAKARGQVEKWLVELERVMINSIHKVTGDATFAYTKYERINWVRDWPGQTVLCVSQIFWTKEVQTAIPMGIKALEQYLKTCNRQIDDIVTLVRGKLSMQNRVTLGALVVLDVHARDVLSSLVKKNISDDSDFEWLSQLRYYWQENHLETKMINAGLRYGYEYLGNSPRLVITPLTDRCYRTLFGALHLHLGGAPEGPAGTGKTETTKDLAKAVAKQCVVFNCSDGLDYLALGKFFKGLLSCGAWACFDEFNRIDLEVLSVVAQQILTIQRGINAGADILMFEGTELKLDPTCAVFITMNPGYAGRSELPDNLKALFRTVAMMVPDYAMIAEIVLYSCGFVTARPLSVKIVATYRLCSEQLSSQHHYDYGMRAVKSVLTAAGNLKLKYPNENEEILLLRSIIDVNLPKFLSHDLPLFEGITSDLFPGVKLPKPDYNDLLAAIKDNCASMNLQMTAFFSEKILQVYEMMIVRHGFMIVGEPFGGKTSAYRVLAGALNDICEKGLMEENKVQITVLNPKSVTMGQLYGQFDSVSHEWSDGVLAVSFRAFASSVTPDRKWLIFDGPVDAVWIENMNTVLDDNKKLCLMSGEIIQMSPQMNLIFEPMDLEVASPATVSRCGMIYMEPHMLGWRPLMLSWVNLLPASVSVIQKEFIMGLFDRMVPVSVEFIRKHTKELSPTSDTNLVRSLMNLIDCFMDDFADEVKLKERNDRETYSLLEGIFLFSLIWSVGASCTDDDRLKFNKILRELMESPISDRTRNTFKLQSGTEQTSSKALTVPFPEKGTIYDYQFVTEGIGKWEPWIKKLKEAPPIPKDVMFNEIIVPTLDTIRYSALMELLTTHQKPSIFVGPTGTGKSVYITNFLLNQLNKEIYKPLLINFSAQTTAAQTQNIVMSKLDKRRKGVFGPPLGKRMVVFVDDVNMPAREVYGAQPPIELLRQWLDHWNWYDLKDCSMIKLVDIQIMCAMGPPGGGRNPVTPRYMRHFNIITINEFSDKSMYTIFSRILTWHLEICYKFPDEFLDLTTQIVNGTMTLYKEAMKNLLPTPAKSHYLFNLRDFSRVIQGVCLSRPETTETTEVIKRLWVHEVLRVYYDRLLDNTDRSWLINYIQEILRNYMYEDFHELFQRLDFDNDGMVEADDLRSLMFCDFHDPKREDTNYREIADVDNLRMIVEIHLEEYNNISKKPMNLVLFRFAIEHISRISRILKQPRSHALLVGVGGSGRQSVTRLAAHMADYSVFQVEISKGYDTTEWHEDLKVILRKCAEGEMQGVFLFTDTQIKEESFLEDVSNLLNAGEIPNLFALDEKQEICDKMRQLDRQRDKTKQTDGSPIALFNMFIDHCRSQLHVVLAMSPIGDAFRNRLRKFPALVNCCTIDWFQSWPEDALQAVASRFLEEIEMSEEIRDGCIDMCKSFHTSTIDLSKSFFVELQRYNYVTPTSYLELISTFKLLLEKKRSEVMKMKKRYEVGLEKLDSASSQVATMQMELEALHPQLKVASKEVDEMMIMIEKESVEVAKTEKIVKADETIANEQAMASKAIKDECDADLAGALPILESALAALDTLTAQDITVVKSMKSPPAGVKLVMEAICILKGIKADKIPDPTGSGKKIEDFWGPAKRLLGDMRFLQSLHEYDKDNIPPAYMNIIRKNYIPNPDFVPEKIRNASTAAEGLCKWVIAMDSYDKVAKIVAPKKIKLAAAEGELKIAMDGLRKKQAALKEVQDKLARLQDTLELNKQKKADLENQVDLCSKKLERAEQLIGGLGGEKTRWSHTALELGQLYINLTGDILISSGVVAYLGAFTSTYRQNQTKEWTTLCKGRDIPCSDDCSLMGTLGEAVTIRTWNIAGLPSDSFSIDNGIIIMNARRWPLMIDPQSQANKWIKNMEKANSLYVIKLSEPDYVRTLENCIQFGTPVLLENVGEELDPILEPLLLKQTFKQGGSTCIRLGDSTIEYAPDFRFYITTKLRNPHYLPETSVKVTLLNFMITPEGMQDQLLGIVVAQERPDLEEEKQALILQGAENKRQLKEIEDKILEVLSSSEGNILEDETAIKILSSSKALANEISQKQEVAEETEKKIDTTRMGYRPIAIHSSILFFSLADLANIEPMYQYSLTWFINLFILSIENSEKSEILAKRLQILKDHFTYSLYVNVCRSLFEKDKLLFSFCLTINLLLHERAINKAEWRFLLTGGIGLDNPYANLCTWLPQKSWDEICRLDDLPAFKTIRREFMRLKDGWKKVYDSLEPHHEVFPEEWEDKANEFQRMLIIRCLRPDKVIPMLQEFIINRLGRAFIEPPPFDLAKAFGDSNCCAPLIFVLSPGADPMAALLKFADDQGYGGSKLSSLSLGQGQGPIAMKMLEKAVKEGTWVVLQNCHLATSWMPTLEKVCEELSPESTHPDFRMWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 5341 - protein, 501 aa, Homo sapiens
MSSRQDKSASKEKSKKPVRFLPQLSMEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIMQQDADLDSAVPDGSTIPKPTASAIEKDILRYYYYIHHGIDTDHVAPMEDSWLEHVLDLVPQHLKVFTDSIVTLSDEMREDYLLSVRKSIVDFVLKDPREKGDDKKTDELPAHRAEMEILPKPWRKSFLAASSYIRDHLNAMNPTMLAVLDLWHTNFKKLRLVDIKEFHNCQDALELSSFQNIIMRHMDSAKETLLKMWFPEVQNIYYQGNKKKQLPTGDSSAKLESFFNCAAALMTLQLQDLTLVSMQDFTDLIAQPPDSVRAFEHPGFIMRLILDNDTIKFEPELSDYIDIFLNVYDVMIKAVSFVPRVETKLYSKWRNKAKPGHFYFSHIQRSVTFQHSEVSSPQNSHFKIVSPFSVLGFTWRCQL

SEQ ID NO: 5342 - protein, 279 aa, Homo sapiens [sequence omitted]

SEQ ID NO: 5343 - protein, 202 aa, Homo sapiens
MEAEAGGLEELTDEEMAALGKEELVRRLRREEAARLAALVQRGRLMQEVNRQLQGHLGEIRELKQLNRRLQAENRELRDLCCFLDSERQRGRRAARQWQLFGTQASRAVREDLGGCWQKLAELEGRQEELLRENLALKELCLALGEEWGPRGGPSGAGGSGAGPAPELALPPCGPRDLGDGSSSTGSVGSPDQLPLACSPDD

SEQ ID NO: 5344 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAASNYARGHYTIGKEIVDLVLDRIRKLADLCTGLQGFLIFHSFGGGTGSGFASLLMERLSVDYSKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLVHKFDLMYAKWAFVHWYVGEGMEEGEFSEAREDLAALEKDCEEVGVDSVEAEAEEGEAY

SEQ ID NO: 5345 - protein, 1025 aa, Homo sapiens
MVAMAEAEAGVAVEVRGLPPAVPDELLTLYFENRRRSGGGPVLSWQRLGCGGVLTFREPADAERVLAQADHELHGAQLSLRPAPPRAPARLLLQGLPPGTTPQRLEQHVQALLRASGLPVQPCCALASPRPDRALVQLPKPLSEADVRVLEEQAQNLGLEGTLVSLARVPQARAVRVVGDGASVDLLLLELYLENERRSGGGPLEDLQRLPGPLGTVASFQQWQVAERVLQQEHRLQGSELSLVPHYDILEPEELAENTSGGDHPSTQGPRATKHALLRTGGLVTALQGAGTVTMGSGEEPGQSGASLRTGPMVQGRGIMTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGPVSPGCVKLAGQEGLVEMVLLMEPGAMRFLQLYHEDLLAGLGDVALLPLEGPDMTGFRLCGAQASCQAAEEFLRSLLGSISCHVLCLEHPGSARFLLGPEGQHLLQGLEAQFQCVFGTERLATATLDTGLEEVDPTEALPVLPGNAHTLWTPDSTGGDQEDVSLEEVRELLATLEGLDLDGEDWLPRELEEEGPQEQPEEEVTPGHEEEEPVAPSTVAPRWLEEEAALQLALHRSLEPQGQVAEQEEAAALRQALTLSLLEQPPLEAEEPPDGGTDGKAQLVVHSAFEQDVEELDRALRAALEVHVQEETVGPWRRTLPAELRARLERCHGVSVALRGDCTILRGFGAHPARAARHLVALLAGPWDQSLAFPLAASGPTLAGQTLKGPWNNLERLAENTGEFQEVVRAFYDTLDAARSSIRVVRVERVSHPLLQQQYELYRERLLQRCERRPVEQVLYHGTTAPAVPDICAHGFNRSFCGRNATVYGKGVYFARRASLSVQDRYSPPNADGHKAVFVARVLTGDYGQGRRGLRAPPLRGPGHVLLRYDSAVDCICQPSIFVIFHDTQALPTHLITCEHVPRASPDDPSGLPGRSPDT

SEQ ID NO: 5346 - protein, 129 aa, Homo sapiens
MSHLQSLLLDTLLGTKHVDSAALIKIQERSLCVASPGFNVTPSDVRTLVNGFAKNPLQARREGLYFKGKDYRCVRADEYSLYAKNENTGVVVVKTHLYLLVATYTEGMYPSICVEATESLGDYLRKKGS

SEQ ID NO: 5347 - protein, 314 aa, Homo sapiens
MLGKGGKRKFDEHEDGLEGKIVSPCDGPSKVSYTLQRQTIFNISLMKLYNHRPLTEPSLQKTVLINNMLRRIQEELKQEGSLRPMFTPSSQPTTEPSDSYREAPPAFSHLASPSSHPCDLGSTTPLEACLTPASLLEDDDDTFCTSQAMQPTAPTKLSPPALLPEKDSFSSALDEIEELCPTSTSTEAATAATDSVKGTSSEAGTQKLDGPQESRADDSKLMDSLPGNFEITTSTGFLTDLTLDDILFADIDTSMYDFDPCTSSSGTASKMAPVSADDLLKTLAPYSSQPVTPSQPFKMDLTELDHIMEVLVGS

SEQ ID NO: 5348 - protein, 81 aa, Homo sapiens
MKGSRIELGDVTPHNIKQLKRLNQVIFPVSYNDKFYKKFGFEIIETKKNYYKRIEPADAHVLQKNLKVPSGQNADVQKTDN

SEQ ID NO: 5349 - protein, 478 aa, Homo sapiens [sequence omitted]

SEQ ID NO: 5350 - protein, 420 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 5351 - protein, 404 aa, Homo sapiens
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 5352 - protein, 1963 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSAELSQGNFWDGLGSPPDSPSPGSDVYCISELNDPQYDQSLLENLFYTAPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDMTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENGITLKPFRTATTLCVPDPIFNSEHHHSLLLPAEVPVQRLLLSAFSAQGLVPGGGVQFEIWCRYYYPNVRDQKVAKGTLPLSRICAMVTTQHREDVGIQTFNLPLTPRIENRKELRNQSSGLLDVGLRYRRSPRTAEGVLAARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITGSY

SEQ ID NO: 5353 - protein, 1861 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSAELSQGNFWDGLGSPPDSPSPGSDVYCISELNDPQYDQSLLENLFYTAPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDMTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENGITLKPFRTATTLCVPDPIFNSEHHHSLLLPAEVPVQRLLLSAFSAQGLVPGGGVQFEIWCRYYYPNVRDQKVAKGTLPLSRICAMVTTQHREDVGIQTFNLPLTPRIENRKELRNQSSGLLDVGLRYRRSPRTAEGVLAARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQT

SEQ ID NO: 5354 - protein, 376 aa, Homo sapiens
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 5355 - protein, 523 aa, Homo sapiens
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEETINMFERNIVDMVGLFIENVQSLMAQCRDLENHHHEKLLEISISTLEKIVEGDLDEDLPNDLRALFVDKDTIVNAVGASHDIHLLKIDNREDELVTRINSWCTRLIDRIHKDEIMRNRKRVKEINQYIDHMQSELDNLECGDILD

SEQ ID NO: 5356 - protein, 559 aa, Homo sapiens
MKVITCEIAWHNKEPVYSLDFQHGTAGRIHRLASAGVDTNVRIWKVEKGPDGKAIVEFLSNLARHTKAVNVVRFSPTGEILASGGDDAVILLWKVNDNKEPEQIAFQDEDEAQLNKENWTVVKTLRGHLEDVYDICWATDGNLMASASVDNTAIIWDVSKGQKISIFNEHKSYVQGVTWDPLGQYVATLSCDRVLRVYSIQKKRVAFNVSKMLSGIGAEGEARSYRMFHDDSMKSFFRRLSFTPDGSLLLTPAGCVESGENVMNTTYVFSRKNLKRPIAHLPCPGKATLAVRCCPVYFELRPVVETGVELMSLPYRLVFAVASEDSVLLYDTQQSFPFGYVSNIHYHTLSDISWSSDGAFLAISSTDGYCSFVTFEKDELGIPLKEKPVLNMRTPDTAKKTKSQTHRGSSPGPRPVEGTPASRTQDPSSPGTTPPQARQAPAPTVIRDPPSITPAVKSPLPGPSEEKTLQPSSQNTKAHPSRRVTLNTLQAWSKTTPRRINLTPLKTDTPPSSVPTSVISTPSTEEIQSETPGDAQGSPPELKRPRLDENKGGTESLDP

SEQ ID NO: 5357 - protein, 508 aa, Homo sapiens
MADGQVAELLLRRLEASDGGLDSAELAAELGMEHQAVVGAVKSLQALGEVIEAELRSTKHWELTAEGEEIAREGSHEARVFRSIPPEGLAQSELMRLPSGKVGFSKAMSNKWIRVDKSAADGPRVFRVVDSMEDEVQRRLQLVRGGQAEKLGEKERSELRKRKLLAEVTLKTYWVSKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVQRVKRTHSQGGYGSQGYKYNWKLDEARKNLLRTHTTSASARALYRLAQKKPFTPVKYFSIDRVFRNETLDATHLAEFHQIEGVVADHGLTLGHLMGVLREFFTKLGITQLRFKPAYNPYTEPSMEVFSYHQGLKKWVEVGNSGVFRPEMLLPMGLPENVSVIAWGLSLERPTMIKYGINNIRELVGHKVNLQMVYDSPLCRLDAEPRPPPTQEAA

SEQ ID NO: 5358 - protein, 400 aa, Homo sapiens
MSSPLASLSKTRKVPLPSEPMNPGRRGIRIYGDEDEVDMLSDGCGSEEKISVPSCYGGIGAPVSRQGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 5359 - protein, 449 aa, Homo sapiens
MASALRPPRVPKPKGVLPSHYYESFLEKKGPCDRDYKKFWAGLQGLTIYFYNSNRDFQHVEKLNLGAFEKLTDEIPWGSSRDPGTHFSLILRDQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPVEKGFHHVAQAGLELLTSSDPPTSASQSAGITGVSHHTWPHLSSLPEPKVFNGGLGRKLPVSSAQPLFPTAGLADMTAELQKKLEKRRALEH

SEQ ID NO: 5360 - protein, 412 aa, Homo sapiens
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 5361 - protein, 860 aa, Homo sapiens
MTEGTKKTSKKFKFFKFKGFGSLSNLPRSFTLRRSSASISRQSHLEPDTFEATQDDMVTVPKSPPAYARSSDMYSHMGTMPRPSIKKAQNSQAARQAQEAGPKPNLVPGGVPDPPGLEAAKEVMVKATGPLEDTPAMEPNPSAVEVDPIRKPEVPTGDVEEERPPRDVHSERAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 5362 - protein, 190 aa, Homo sapiens
MTVPWRPGKRRITYKEEEDLTLQPRPASSAPESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 5363 - protein, 508 aa, Homo sapiens
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 5364 - protein, 385 aa, Homo sapiens
MGRWCQTVARGQRPRTSAPSRAGALLLLLLLLRSAGCWGAGEAPGALSTADPADQSVQCVPKATCPSSRPRLLWQTPTTQTLPSTTMETQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 5365 - protein, 249 aa, Homo sapiens
MVDRLANSEANTRRISIVENCFGAAGQPLTIPGRVLIGEGVLTKLCRKKPKARQFFLFNDILVYGNIVIQKKKYNKQHIIPLENVTIDSIKDEGDLRNGWLIKTPTKSFAVYAATATEKSEWMNHINKCVTDLLSKSGKTPSNEHAAVWVPDSEATVCMRCQKAKFTPVNRRHHCRKCGFVVCGPCSEKRFLLPSQSSKPVRICDFCYDLLSAGDMATCQPARSDSYSQSLKSPLNDMSDDDDDDDSSD

SEQ ID NO: 5366 - protein, 914 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRAISEKERMKDRKFSWGQQRTNSEQVDEDADVDTAMAALDDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 5367 - protein, 446 aa, Homo sapiens
MRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQGFRPMSLSTQTVLVMLCSESAGALWRQRLS

SEQ ID NO: 5368 - protein, 631 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEASATANPVHRRFQPTPARGAGKKKGLPPLHIPPDPKARESQMAPAAPDVPAHIGGQGRAWARFPGLSSAASLLE

SEQ ID NO: 5369 - protein, 490 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 5370 - protein, 208 aa, Homo sapiens
MAASVEQREGTIQVQGQALFFREALPGSGQARFSVLLLHGIRFSSETWQNLGTLHRLAQAGYRAVAIDLPGLKGEPPAQEPLLSQSRASFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 5371 - protein, 181 aa, Homo sapiens
MESRSVAQAGVQWCDLGSLQPPPPGFKQFSYFSLQSSWDYRYVPPCPANFVFLVEMGFLHVDQAGLKLLTSGIDFATRKIAKLLKPQKVIEQNGDSFTIHTNSSLRNYFVKFKVGEEFDEDNRGLDNRKCKSLVIWDNDRLTCIQKGEKKNRGWTHWIEGDKLHLEMFCEGQVCKQTFQRA

SEQ ID NO: 5372 - protein, 548 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQIGFEAPPLQGQAAAPASGSGADSEPARHIFSFSWLNSLNE

SEQ ID NO: 5373 - protein, 457 aa, Homo sapiens
MFPKFSLRSMFHGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 5374 - protein, 245 aa, Homo sapiens
MAGLELLSDQGYRVDGRRAGELRKIQARMGVFAQADGSAYIEQGNTKALAVVYGPHEIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 5375 - protein, 876 aa, Homo sapiens
MMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 5376 - protein, 2096 aa, Homo sapiens
MCSTPGMPAPGASLALRVSFVDVHPDVIPVQLWGLVGERRGEYLRLSREIQEAAATRGQWALGSASASPGELCLVQVGLLWHRCRVVSRQAQESRVFLLDEGRTITAGAGSLAPGRREFFNLPSEVLGCVLAGLVPAGCGAGSGEPPQHWPADAVDFLSNLQGKEVHGCVLDVLLLHRLVLLEVPDVFQQMRELGLARRVPDSLFRSLLERYLTAATASVGSGVPVLSRVPLKQKQPGLDYFYPQLQLGVTEAVVITQVCHPHRIHCQLRSVSQEIHRLSESMAQVYRGSTGTGDENSTSATWEEREESPDKPGSPCASCGLDGHWYRALLLETFRPQRCAQVLHVDYGRKELVSCSSLRYLLPEYFRMPVVTYPCALYGLWDGGRGWSRSQVGDLKTLILGKAVNAKIEFYCSFEHVYYVSLYGEDGINLNRVFGVQSCCLADRVLQSQATEEEEPETSQSQSPAEEVDEEISLPALRSIRLKMNAFYDAQVEFVKNPSEFWIRLRKHNVTFSKLMRRMCGFYSSASKLDGVVLKPEPDDLCCVKWKENGYYRAIVTKLDDKSVDVFLVDRGNSENVDWYDVRMLLPQFRQLPILAVKCTLADIWPLGKTWSQEAVSFFKKTVLHKELVIHILDKQDHQYVIEILDESRTGEENISKVIAQAGYAKYQEFETKENILVNAHSPGHVSNHFTTESNKIPFAKTGEGEQKAKRENKTTSVSKALSDTTVVTNGSTELVVQEKVKRASVYFPLMQNCLEIKPGSSSKGELEVGSTVEVRVSYVENPGYFWCQLTRNIQGLKTLMSDIQYYCKNTAAPHQRNTLACLAKRTVNRQWSRALISGIQSVEHVNVTFVDYGDREMVSVKNIYSISEEFLKVKAQAFRCSLYNLIQPVGQNPFVWDVKAIQAFNEFIDNAWQKNLELKCTIFALASINEELFNIVDLLTPFQSACHFLVEKRLARPVKLQKPLESSVQLHSYFYSTHDMKIGSEELVYITHIDDPWTFYCQLARNANILEQLSCSITQLSKVLLNLKTSPLNPGTLCLAKYTDGNWYRGIVIEKEPKKVFFVDFGNIYVVTSDDLLPIPSDAYDVLLLPMQAVRCSLSDIPDHIPEEVVVWFQETILDKSLKALVVAKDPDGTLIIELYGDNIQISASINKKLGLLSYKDRIRKKESEVLCSTTETLEEKNENMKLPCTEYLSKSVGYKLPNKEILEESYKPQINSSYKELKLLQSLTKTNLVTQYQDSVGNKNSQVFPLTTEKKEEISAETPLKTARVEATLSERKIGDSCDKDLPLKFCEFPQKTIMPGFKTTVYVSHINDLSDFYVQLIEDEAEISHLSERLNSVKTRPEYYVGPPLQRGDMICAVFPEDNLWYRAVIKEQQPNDLLSVQFIDYGNVSVVHTNKIGRLDLVNAILPGLCIHCSLQGFEVPDNKNSKKMMHYFSQRTSEAAIRCEFVKFQDRWEVILADEHGIIADDMISRYALSEKSQVELSTQVIKSASSKSVNKSDIDTSVFLNWYNPEKKMIRAYATVIDGPEYFWCQFADTEKLQCLEVEVQTAGEQVADRRNCIPCPYIGDPCIVRYREDGHYYRALITNICEDYLVSVRLVDFGNIEDCVDPKALWAIPSELLSVPMQAFPCCLSGFNISEGLCSQEGNDYFYEIITEDVLEITILEIRRDVCDIPLAIVDLKSKGKSINEKMEKYSKTGIKSALPYENIDSEIKQTLGSYNLDVGLKKLSNKAVQNKIYMEQQTDELAEITEKDVNIIGTKPSNFRDPKTDNICEGFENPCKDKIDTEELEGELECHLVDKAEFDDKYLITGFNTLLPHANETKEILELNSLEVPLSPDDESKEFLELESIELQNSLVVDEEKGELSPVPPNVPLSQECVTKGAMELFTLQLPLSCEAEKQPELELPTAQLPLDDKMDPLSLGVSQKAQESMCTEDMRKSSCVESFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRVLNLSNGMEEIVNPENVWNGIPKLDKSPPEKRGLEVMEI

SEQ ID NO: 5377 - protein, 229 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEGLTLPPRLECSGMITAHCSLNLPRLRWSSCLSPLLRLQVTIVVLGNKCDLQEQRRVDPDVAQHWAKSEKVKLWEVSVADRRSLLEPFVYLASKMTQPQSKSAFPLSRKNKGSGSLDG

SEQ ID NO: 5378 - protein, 803 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 5379 - protein, 374 aa, Homo sapiens
MRAPMLQKQQAPRMDTPPPEERLEKQNEKLNNQEEETEFKELDGLREALANLRGLSEEERSEKAMLRSRIEEQSQLICILKRRSDEALERCQILELLNAELEEKMMQEAEKLKAQGEYSRKLEERFMTLAANHELMLRFKDEYKSENIKLREENEKLRLENSSLFSQALKDEEAKVLQLTVRCEALTGELETLKERCAQDACQAQAREKELLELQSQQACTHTKETEQLRSQLQTLKQQHQQAVEQIAKAEETHSSLSQELQARLQTVTREKEELLQLSIERGKVLQNKQAEICQLEEKLEIANEDRKHALERFEQEAVAVDSNLRVRELQRKVDGIQKAYDELRLQSEAFKKHSLDLLSKERELNGKLRHLSP

SEQ ID NO: 5380 - protein, 194 aa, Homo sapiens
MEDGLLEIMTKDGGDMPAPLEVSTVPAVGDVISGEYNGGMKELMEHLKAQLQALFEDVRAMRGALDEQASHIQVLSDDVCANQRAIVSMCQIMTTAPRQGGLGVVGGKGSFQSDPQEPETPSPGIGDSGLLGRDPEDEEEEEEEKEMPSPATPSSHCERPESPCAGLLGGDGPLVEPLDMPDITLLQLEGEASL

SEQ ID NO: 5381 - protein, 426 aa, Homo sapiens
MAHLRGFANQHSRVDPEELFTKLDRIGKGSFGEVYKGIDNHTKEVVAIKIIDLEEAEDEIEDIQQEITVLSQCDSPYITRYFGSYLKSTKLWIIMEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 5382 - protein, 449 aa, Homo sapiens
MMLSTEGREGFVVKVRGLPWSCSADEVMRFFSDCKIQNGTSGIRFIYTREGRPSGEAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 5383 - protein, 438 aa, Homo sapiens
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 5384 - protein, 54 aa, Homo sapiens
MPGKKARKNAQPSPARAPAELEVECATQLRRFGDKLNFRQKLLNLISKLFCSGT

SEQ ID NO: 5385 - protein, 467 aa, Homo sapiens
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 5386 - protein, 185 aa, Homo sapiens
MGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYQSMADQEKISPAALKKTLLDRVKLESPTVSTLTPSSPGKLLTRSLALGGKKD

SEQ ID NO: 5387 - protein, 319 aa, Homo sapiens [sequence omitted]

SEQ ID NO: 5388 - protein, 235 aa, Homo sapiens
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 5389 - protein, 1290 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 5390 - protein, 673 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKLRFPCRITESKNMNILIVLDMLCYISSEKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 5391 - protein, 265 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSPQEKTLCK

SEQ ID NO: 5392 - protein, 211 aa, Homo sapiens
MWASLSLDHPSAKENQALRLIEMREENGNVPKTEQAGSLKPLRDTGKSNLKEKKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 5393 - protein, 288 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLARYAVRRSLGLQYLPDAVKGLPLPASLKEYLLLLE

SEQ ID NO: 5394 - protein, 446 aa, Homo sapiens
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 5395 - protein, 263 aa, Homo sapiens
MLSSKGLTVVDVYQGWCGPCKPVVSLFQKMRIEVGLDLLHFALAEADRLDVLEKYRGKCEPTFLFYAIKDEALSDEDECVSHGKNNGEDEDMVSSERTCTLAIIKPDAVAHGKTDEIIMKIQEAGFEILTNEERTMTEAEVRLFYQHKAGEEAFEKLVHHMCSGPSHLLILTRTEGFEDVVTTWRTVMGPRDPNVARREQPESLRAQYGTEMPFNAVHGSRDREDADRELALLFPSLKFSDKDTEAPQGESSTQPRLKITDLD

SEQ ID NO: 5396 - protein, 362 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQALRRETHECSICLAPLSAAGGQRVGAGRRSREMALLSCSHVFHHACLLALEEFSVGDRPPFHACPLCRSCYQKKILEC

SEQ ID NO: 5397 - protein, 96 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLG

SEQ ID NO: 5398 - protein, 152 aa, Homo sapiens
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 5399 - protein, 1117 aa, Homo sapiens
MYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQGQFQKSSDFQKEGLQQTFLPPERQG

SEQ ID NO: 5400 - protein, 191 aa, Homo sapiens
MYVCLCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 5401 - protein, 109 aa, Homo sapiens
MAGAPTVSLPELRSLLASGRARLFDVRSREEAAAGTIPGALNIPVSELESALQMEPAAFQALYSAEKPKLEDEHLVFFCQMGKRGLQATQLARSLGYTGYGEVWLLAGR

SEQ ID NO: 5402 - protein, 209 aa, Homo sapiens
MALLAEHLLKPLPADKQIETGPFLEAVSHLPPFFDCLGSPVFTPIKADISGNITKIKAVYDTNPAKFRTLQNILEVEKEMYGAEWPKVGATLALMWLKRGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 5403 - protein, 157 aa, Homo sapiens
MEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 5404 - protein, 212 aa, Homo sapiens
MEVLRRSSVFAAEIMDAFDRSPTDKELVAQAKALGREYVHARLLRAGLSWSAPERAAPVPGRLAEVCAVLLRLGDELEMIRPSVYRNVARQLHISLQSEPVVTDAFLAVAGHIFSAGITWGKVVSLYAVAAGLAVDCVRQAQPAMVHALVDCLGEFVRKTLATWLRRRGGWTDVLKCVVSTDPGLRSHWLVAALCSFGRFLKAAFFVLLPER

SEQ ID NO: 5405 - protein, 715 aa, Homo sapiens
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 5406 - protein, 199 aa, Homo sapiens
MAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQVPEVRKKFTPNPSAIFQASAPRILNV

SEQ ID NO: 5407 - protein, 1701 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 5408 - protein, 1058 aa, Homo sapiens
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTEDDPQEVSATVYLDKLATVISVWNSDTQNPYHQQALAEKVKEAERDVSLTSLAKLPSETIFVGCEFLHHLLREWGEELQAVLRSSQGTSYDSYRLCDSLTSFSQNATLYLNRTSLSKEDRQVVSELAECVRDFLRKTSTVLKNRALEDITASIAMAVIQQKMDRHMEVCYIFASEKKWAFSDEWVACLGSNRALFRQPDLVLRLLETVIDVSTADRAIPESQIRQVIHLILECYADLSLPGKNKVLAGILRSWGRKGLSEKLLAYVEGFQEDLNTTFNQLTQSASEQGLAKAVASVARLVIVHPEVTVKKMCSLAVVNLGTHKFLAQILTAFPALRFVEEQGPNSSATFMVSCLKETVWMKFSTPKEEKQFLELLNCLMSPVKPQGIPVAALLEPDEVLKEFVLPFLRLDVEEVDLSLRIFIQTLEANACREEYWLQTCSPFPLLFSLCQLLDRFSKYWQLPKEKRCLSLDRKDLAIHILELLCEIVSANAETFSPDVWIKSLSWLHRKLEQLDWTVGLRLKSFFEGHFKCEVPATLFEICKLSEDEWTSQAHPGYGAGTGLLAWMECCCVSSGISERMLSLLVVDVGNPEEVRLFSKGFLVALVQVMPWCSPQEWQRLHQLTRRLLEKQLLHVPYSLEYIQFVPLLNLKPFAQELQLSVLFLRTFQFLCSHSCRDWLPLEGWNHVVKLLCGSLTRLLDSVRAIQAAGPWVQGPEQDLTQEALFVYTQVFCHALHIMAMLHPEVCEPLYVLALETLTCYETLSKTNPSVSSLLQRAHEQRFLKSIAEGIGPEERRQTLLQKMSSF

SEQ ID NO: 5409 - protein, 88 aa, Homo sapiens
MSGLRVYSTSVTGSREIKSQQSEVTRILDGKRIQYQLVDISQDNALRDEMRALAGNPKATPPQIVNGDQYCGVWAGGRGGGGSVGRGL

SEQ ID NO: 5410 - protein, 310 aa, Homo sapiens
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHN

SEQ ID NO: 5411 - protein, 199 aa, Homo sapiens; identical to SEQ ID NO: 4921

SEQ ID NO: 5412 - protein, 170 aa, Homo sapiens
MSVAGGEIRGDTGGEDTAAPGRFSFSPEPTLEDIRRLHAEFAAERDWEQFHQPRNLLLALVGEVGELAELFQWKTDGEPGPQGWSPRERAALQEELSDVLIYLVALAARCRVDLPLAVLSKMDINRRRYPAHLARSSSRKYTELPHGAISEDQAVGPADIPCDSTGQTST

SEQ ID NO: 5413 - protein, 233 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGNIPSEASGLYKGGEEPVTTQPSVGHAVPAPKSQTEGR

SEQ ID NO: 5414 - protein, 731 aa, Homo sapiens
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 5415 - protein, 322 aa, Homo sapiens
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERRETELCEHWEEHTRQRELPLRGPLGGTVLETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 5416 - protein, 1722 aa, Homo sapiens
MGNQDGKLKRSAGDALHEGGGGAEDALGPRDVEATKKGSGGKKALGKHGKGGGGGGGGGESGKKKSKSDSRASVFSNLRIRKNLSKGKGAGGSREDVLDSQALQTGELDSAHSLLTKTPDLSLSADEAGLSDTECADPFEVTGPGGPGPAEARVGGRPIAEDVETAAGAQDGQRTSSGSDTDIYSFHSATEQEDLLSDIQQAIRLQQQQQQQLQLQLQQQQQQQQLQGAEEPAAPPTAVSPQPGAFLGLDRFLLGPSGGAGEAPGSPDTEQALSALSDLPESLAAEPREPQQPPSPGGLPVSEAPSLPAAQPAAKDSPSSTAFPFPEAGPGEEAAGAPVRGAGDTDEEGEEDAFEDAPRGSPGEEWAPEVGEDAPQRLGEEPEEEAQGPDAPAAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGRTLLEKLFSQQENGPPEEAEKFCSRIIAMGLLLPFSDCFREPCNQNAQTNAASFDQDQLYTWAAVSQPTHSLDYSEGQFPRRVPSMGPPSKPPDEEHRLEDAETESQSAVSETPQKRSDAVQKEVVDMKSEGQATVIQQLEQTIEDLRTKIAELERQYPALDTEVASGHQGLENGVTASGDVCLEALRLEEKEVRHHRILEAKSIQTSPTEEGGVLTLPPVDGLPGRPPCPPGAESGPQTKFCSEISLIVSPRRISVQLDSHQPTQSISQPPPPPSLLWSAGQGQPGSQPPHSISTEFQTSHEHSVSSAFKNSCNIPSPPPLPCTESSSSMPGLGMVPPPPPPLPGMTVPTLPSTAIPQPPPLQGTEMLPPPPPPLPGAGIPPPPPLPGAGILPLPPLPGAGIPPPPPLPGAAIPPPPPLPGAGIPLPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGVGIPPPPPLPGAGIPPPPPLPGAGIPPPPPLPGAGIPPPPPLPRVGIPPPPPLPGAGIPPPPPLPGAGIPPPPPLPGVGIPPPPPLPGVGIPPPPPLPGAGIPPPPPLPGMGIPPAPAPPLPPPGTGIPPPPLLPVSGPPLLPQVGSSTLPTPQVCGFLPPPLPSGLFGLGMNQDKGSRKQPIEPCRPMKPLYWTRIQLHSKRDSSTSLIWEKIEEPSIDCHEFEELFSKTAVKERKKPISDTISKTKAKQVVKLLSNKRSQAVGILMSSLHLDMKDIQHAVVNLDNSVVDLETLQALYENRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 5417 - protein, 1015 aa, Homo sapiens
MTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 5418 - protein, 847 aa, Homo sapiens
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAASTFEPGSYQFSFTQLLPAPREETRLENPATHPVLDQPCGQGLPAPNNSIQGKKVELAARLQKMLQDLHTEQERLQGEAQAWARRQAALEAAVRQACAPQELERFSRFMADLERVLGLLLLLGSRLARVRRALARAASDSDPDEQRLRLLQRQEEDAKELKEHVARRERAVREVLVRALPVEELRVYCALLAGKAAVLAQQRNLDERIRLLQDQLDAIRDDLGHHAPSPSPARPPGTCPPVQPPFPLLLT

SEQ ID NO: 5419 - protein, 833 aa, Homo sapiens
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 5420 - protein, 305 aa, Homo sapiens; identical to SEQ ID NO: 5213

SEQ ID NO: 5421 - protein, 372 aa, Homo sapiens
MDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 5422 - protein, 563 aa, Homo sapiens
MRLDLASLMSAPKSLGSAFKSWRLDKAPSPQHTFPSTSIPGMAFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFLLQVPGLCILSYPTPLYFGTRGQFRCNLEWHLGLGEGEKETSKPDGPMVAVAEPVRVVVLDFSGVTFADAAGAREVVQVRERLASRCRDARIRLLLAQCNALVQGTLTRVGLLDRVTPDQLFVSVQDAAAYALGSLLRGSSTRSGSQEALGCGK

SEQ ID NO: 5423 - protein, 963 aa, Homo sapiens
MAERGGAGGGPGGAGGGSGQRGSGVAQSPQQPPPQQQQQQPPQQPTPPKLAQATSSSSSTSAAAASSSSSSTSTSMAVAVASGSAPPGGPGPGRTPAPVQMNLYATWEVDRSSSSCVPRLFSLTLKKLVMLKEMDKDLNSVVIAVKLQGSKRILRSNEIVLPASGLVETELQLTFSLQYPHFLKRDANKLQIMLQRRKRYKNRTILGYKTLAVGLINMAEVMQHPNEGALVLGLHSNVKDVSVPVAEIKIYSLSSQPIDHEGIKSKLSDRSPDIDNYSEEEEESFSSEQEGSDDPLHGQDLFYEDEDLRKVKKTRRKLTSTSAITRQPNIKQKFVALLKRFKVSDEVGFGLEHVSREQIREVEEDLDELYDSLEMYNPSDSGPEMEETESILSTPKPKLKPFFEGMSQSSSQTEIGSLNSKGSLGKDTTSPMELAALEKIKSTWIKNQDDSLTETDTLEITDQDMFGDASTSLVVPEKVKTPMKSSKTDLQGSASPSKVEGVHTPRQKRSTPLKERQLSKPLSERTNSSDSERSPDLGHSTQIPRKVVYDQLNQILVSDAALPENVILVNTTDWQGQYVAELLQDQRKPVVCTCSTVEVQAVLSALLTRIQRYCNCNSSMPRPVKVAAVGGQSYLSSILRFFVKSLANKTSDWLGYMRFLIIPLGSHPVAKYLGSVDSKYSSSFLDSGWRDLFSRSEPPVSEQLDVAGRVMQYVNGAATTHQLPVAEAMLTCRHKFPDEDSYQKFIPFIGVVKVGLVEDSPSTAGDGDDSPVVSLTVPSTSPPSSSGLSRDATATPPSSPSMSSALAIVGSPNSPYGDVIGLQVDYWLGHPGERRREGDKRDASSKNTLKSVFRSVQVSRLPHSGEAQLSGTMAMTVVTKEKNKKVPTIFLSKKPREKEVDSKSQVIEGISRLICSAKQQQTMLRVSIDGVEWSDIKFFQLAAQWPTHVKHFPVGLFSGSKAT

SEQ ID NO: 5424 - protein, 181 aa, Homo sapiens
MEEIPAQEAAGSPRVQFQSLETQSECLSPEPQFVQDTDMEQGLTGAPPVPQVPALPREGSPGDQAAALLTARYQEFVTFEDVAVHLTREEWGYLDPVQRDLYREVMLENYGNVVSLGILLRLPTTRIHSVNSCPALSHTQASAFSGETLAVLTAGISKRWPKYRLPIDIARPCSETPFPRL

SEQ ID NO: 5425 - protein, 469 aa, Homo sapiens
MVLEGNPEVGSPRTSDLQHRGNKGSCVLSSPGEDAQPGEEPIKYGELIVLGCCEEGGEETEAQRGEVTGPRAHSCYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGCVRLIFQGPLD

SEQ ID NO: 5426 - protein, 1103 aa, Homo sapiens
MAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 5427 - protein, 419 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLKLYPPGDEEEAELADSSGLYHEGSPSPGSPWKTKLRTKDKEEKKKTEFLDLDNSPLSPPSPRTKSRTHTRALKKLSEVNKRLQDLRSCLSPKPPQGQEQQGQEDEVVLVEGPTLPETPRLFPLKIRCRADLVRLPLRMSEPLQSVVDHMATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 5428 - protein, 127 aa, Homo sapiens
MRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 5429 - protein, 420 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEERKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKALELLMPPVTDNANARMKAHVRRGTAFCQLELYVEGLQDYEAALKIDPSNKIVQIDAEKIRNVIQGTELKS

SEQ ID NO: 5430 - protein, 115 aa, Homo sapiens
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 5431 - protein, 410 aa, Homo sapiens
LNRACFCVTGVPELEVICGLQQAEWPRLGLSHLGAVGGGWGGLPTSTWVSLHTQEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 5432 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 5433 - protein, 156 aa, Homo sapiens
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 5434 - protein, 331 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 5435 - protein, 619 aa, Homo sapiens
MAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEMAYQVVEKGAALGTLESELQQRQSRLAALEARVAQLREARAQQAQQVEEWRAQNAVQRAAYEALRAHVGLREAALRRLQEEARDLLERLVQRKARAAAERNLRNERRERAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 5436 - protein, 1682 aa, Homo sapiens
MEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 5437 - protein, 244 aa, Homo sapiens
GGGYDLNLFASPPDSNFVCSVCHGVLKRPARLPCSHIFCKKCILRWLARQKTCPCCRKEVKRKKVVHMNKLRKTIGRLEVKCKNADAGCIVTCPLAHRKGHQDSCPFELTACPNEGCTSQVPRGTLAEHRQHCQQGSQQRCPLGCGATLDPAERARHNCYRELHNAWSVRQERRRPLLLSLLRRVRWLDQATSVVRRELAELSNFLEEDTALLEGAPQEEAEAAPEGNVGAEVVGEPRANIPCK

SEQ ID NO: 5438 - protein, 234 aa, Homo sapiens
LPCKRCRPSVYSLSYIKRGKTRNYLYPIWSPYAYYLYCYKYRITLREKMLPRCYKSITYKEEEDLTLQPRSCLQCESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 5439 - protein, 800 aa, Homo sapiens
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQILGFDILLMKNLKPILLEVNANPSMRIEHEHELSPGVFENVPSLVDEEVKVAVIRDTLRLMDPLKKKRENQSQQLEKPFAGKEDALDGELTSAPDCNANPEAHLPSICLKQVFPKYAKQFNYLRLVDRMANLFIRFLGIKGTMKLGPTGFRTFIRSCKLSSSSLSMAAVDILYIDITRRWNSMTLDQRDSGMCLQAFVEAFFFLAQRKFKMLPLHEQVASLIDLCEYHLSLLDEKRLVCGRGVPSGGRPPHRGPPQEPSPSAQPAGDNPPPRTSCANKLSHPRHTLS

SEQ ID NO: 5440 - protein, 326 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLKSFFATKPRIHFPLATYAPVISAEKAYHEQLTVAEITNACFEPANQMVKCDPRHGKYMACCLLYRGDVVPKDVNAAIATIKTKRTIQFVDWCPTGFKVGINYQPPTVVPGGDLAKVQRAVCMLSNTTAVAEAWARLDHKFDLMPLRRIMRRLEQIVLTERMRVKSINLCAVLLHSFVLELSYFCSVNVYCRKLLIKLKFPF

SEQ ID NO: 5441 - protein, 334 aa, Homo sapiens
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 5442 - protein, 170 aa, Homo sapiens
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATKATTVGAVDRLTDTSKYTGTHKERFDESGKGKGIAGREEMTDNTGYVSGYKGSGTYDKKTK

SEQ ID NO: 5443 - protein, 1193 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 5444 - protein, 3046 aa, Homo sapiens
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 5445 - protein, 308 aa, Homo sapiens
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 5446 - protein, 403 aa, Homo sapiens
MSGSDGGLEEEPELSITLTLRMLMHGKEVGSIIGKKGETVKRIREQSSARITISEGSCPERITTITGSTAAVFHAVSMIAFKLDEDLCAAPANGGNVSRPPVTLRLVIPASQCGSLIGKAGTKIKEIRETTGAQVQVAGDLLPNSTERAVTVSGVPDAIILCVRQICAVILESPPKGATIPYHPSLSLGTVLLSANQGFSVQGQYGAVTPAEVTKLQQLSSHAVPFATPSVVPGLDPGTQTSSQEFLVPNDLIGCVIGRQGSKISEIRQMSGAHIKIGNQAEGAGERHVTITGSPVSIALAQYLITACLETAKSTSGGTPSSAPADLPAPFSPPLTALPTAPPGLLGTPYAISLSNFIGLKPMPFLALPPASPGPPPGLAAYTAKMAAANGSKKAERQKFSPY

SEQ ID NO: 5447 - protein, 217 aa, Homo sapiens
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 5448 - protein, 1052 aa, Homo sapiens
MEGSEPVAAHQGEEASCSSWGTGSTNKNLPIMSTASVEIDDALYSRQRYVLGDTAMQKMAKSHVFLSGMGGLGLEIAKNLVLAGIKAVTIHDTEKCQAWDLGTNFFLSEDDVVNKRNRAEAVLKHIAELNPYVHVTSSSVPFNETTDLSFLDKYQCVVLTEMKLPLQKKINDFCRSQCPPIKFISADVHGIWSRLFCDFGDEFEVLDTTGEEPKEIFISNITQANPGIVTCLENHPHKLETGQFLTFREINGMTGLNGSIQQITVISPFSFSIGDTTELEPYLHGGIAVQVKTPKTVFFESLERQLKHPKCLIVDFSNPEAPLEIHTAMLALDQFQEKYSRKPNVGCQQDSEELLKLATSISETLEEKPDVNADIVHWLSWTAQGFLSPLAAAVGGVASQEVLKAVTGKFSPLCQWLYLEAADIVESLGKPECEEFLPRGDRYDALRACIGDTLCQKLQNLNIFLVGCGAIGCEMLKNFALLGVGTSKEKGMITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQKIQSGHSLEGCFQVIKLLSRRPRNWSQCVELARLKFEKYFNHKALQLLHCFPLDIRLKDGSLFWQSPKRPPSPIKFDLNEPLHLSFLQNAAKLYATVYCIPFAEEDLSADALLNILSEVKIQEFKPSNKVVQTDETARKPDHVPISSEDERNAIFQLEKAILSNEATKSDLQMAVLSFEKDDDHNGHIDFITAASNLRAKMYSIEPADRFKTKRIAGKIIPAIATTTATVSGLVALEMIKVTGGYPFEAYKNCFLNLAIPIVVFTETTEVRKTKIRNGISFTIWDRWTVHGKEDFTLLDFINAVKEKYGIEPTMVVQGVKMLYVPVMPGHAKRLKLTMHKLVKPTTEKKYVDLTVSFAPDIDGDEDLPGPPVRYYFSHDTD

SEQ ID NO: 5449 - protein, 377 aa, Homo sapiens
MLRLVPTGARAIVDMSYARHFLDFQGSAIPQAMQKLVVTRLSPNFREAVTLSRDCPVPLPGDGDLLVRNRFVGVNASDINYSAGRYDPSVKPPFDIGFEGIGEVVALGLSASARYTVGQAVAYMAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 5450 - protein, 845 aa, Homo sapiens
MSNSRPRSRRDAGGGAGAAGRDELVSRSLQSAEHCLGVQDFGTAYAHYLLVLSLAPELKHDVKETFQYTLFRWAEELDALSRIQDLLGCYEQALELFPDDEVICNSMGEHLFRMGFRDEAAGYFHKAVKLNPDFSDAKENFYRVANWLVERWHFIMLNDTKRNTIYNAAIQKAVCLGSKSVLDIGAGTGILSMFAKKAGAHSVYACELSKTMYELACDVVAANKMEAGIKLLHTKSLDIEIPKHIPERVSLVVTETVDAGLFGEGIVESLIHAWEHLLLQPKTKGESANCEKYGKVIPASAVIFGMAVECAEIRRHHRVGIKDIAGIHLPTNVKFQSPAYSSVDTEETIEPYTTEKMSRVPGGYLALTECFEIMTVDFNNLQELKSLATKKPDKIGIPVIKEGILDAIMVWFVLQLDDEHSLSTSPSEETCWEQAVYPVQDLADYWIKPGDHVMMEVSCQDCYLRIQSISVLGLECEMDVAKSFTQNKDLLSLGNEAELCSALANLQTSKPDAVEQTCILESTEIALLNNIPYHEGFKMAMSKVLSSLTPEKLYQTMDTHCQNEMSSGTGQSNTVQNILEPFYVLDVSEGFSVLPVIAGTLGQVKPYSSVEKDQHRIALDLISEANHFPKETLEFWLRHVEDESAMLQRPKSDKLWSIIILDVIEPSGLIQQEIMEKAAISRCLLQSGGKIFPQYVLMFGLLVESQTLLEENAVQGTERTLGLNIAPFINQFQVPIRVFLDLSSLPCIPLSKPVELLRLDLMTPYLNTSNREVKVYVCKSGRLTAIPFWYHMYLDEEIRLDTSSEASHWKQAAVVLDNPIQVEMGEELVLSIQHHKSNVSITVKQ

SEQ ID NO: 5451 - protein, 251 aa, Homo sapiens
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 5452 - protein, 169 aa, Homo sapiens
MAPKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEEIKNMWAAFPPDVGGNVDYKNICYVITHGDAKDQE

SEQ ID NO: 5453 - protein, 181 aa, Homo sapiens
MATEPEAAEPVVPSLVDRYFTRWYKPDVKGKFCEDHCILQHSNRICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 5454 - protein, 717 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVRGKPVWEPLQHVFGCLGHCWGK

SEQ ID NO: 5455 - protein, 225 aa, Homo sapiens
MVMAEGTAVLRRNRPGTKAQDFYNWPDESFDEMDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 5456 - protein, 390 aa, Homo sapiens
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 5457 - protein, 44 aa, Homo sapiens
MSDKPDMAEIEKFDKSKLKKTEMQEKNPLPSKETIEQEKQASES

SEQ ID NO: 5458 - protein, 440 aa, Homo sapiens
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDGSENLAGKPALQIPSSRAAAPRPPVSAASGRPQDDTDSSRASLPELPRMQRPSLPDLSRPNTTSSTGMKHSSSAPPPPPPGRRANAPPTPLPMHSSKAPAYNREKPLPPTPGQRLHPGREGPPAPPPVKPPPSPVNIRTGPSGQSLAPPPPPYRQPPGVPNGPSSPTNESAPELPQRHNSLHRKTPGPVRGLAPPPPTSASPSLLSNRPPPPARDPPSRGAAPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 5459 - protein, 900 aa, Homo sapiens
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSAYFRLQESFFNLPQLLFPENVMQNKDNALVELDHRIDFELREGLVESRYWSAVTSHTAYWSSLDVALFLLTFMYKHEHDDDAKPNLDPI

SEQ ID NO: 5460 - protein, 425 aa, Homo sapiens
MNKMPAGEQECEYNKEGKYYSKGVKLVRKKKKIPGYRWGDIKINIIGEKDDLPIHFCDKCDLPIKIYGRIIPCKHAFCYHCANLYDKVGYKVCPRCRYPVLRIEAHKRGSVFMCSIVQQCKRTYLSQKSLQAHIKRRHKRARKQVTSASLEKVRPHIAPPQTEISDIPKRLQDRDHLSYIPPEQHTMVSLPSVQHMLQEQHNQPHKDIQAPPPELSLSLPFPIQWETVSIFTRKHGNLTVDHIQNNSDSGAKKPTPPDYYPECQSQPAVSSPHHIIPQKQHYAPPPSPSSPVNHQMPYPPQDVVTPNSVRSQVPALTTTYDPSSGYIIVKVPPDMNSPPLRAPQSQNGNPSASEFASHHYNLNILPQFTENQETLSPQFTQTDAMDHRRWPAWKRLSPCPPTRSPPPSTLHGRSHHSHQRRHRRY

SEQ ID NO: 5461 - protein, 641 aa, Homo sapiens
MGPPLKLFKNQKYQELKQECIKDSRLFCDPTFLPENDSLFYNRLLPGKVVWKRPQDICDDPHLIVGNISNHQLTQGRLGHKPMVSAFSCLAVQESHWTKTIPNHKEQEWDPQKTEKYAGIFHFRFWHFGEWTEVVIDDLLPTINGDLVFSFSTSMNEFWNALLEKAYAKLLGCYEALDGLTITDIIVDFTGTLAETVDMQKGRYTELVEEKYKLFGELYKTFTKGGLICCSIESPNQEEQEVETDWGLLKGHTYTMTDIRKIRLGERLVEVFSAEKVYMVRLRNPLGRQEWSGPWSEISEEWQQLTASDRKNLGLVMSDDGEFWMSLEDFCRNFHKLNVCRNVNNPIFGRKELESVLGCWTVDDDPLMNRSGGCYNNRDTFLQNPQYIFTVPEDGHKVIMSLQQKDLRTYRRMGRPDNYIIGFELFKVEMNRKFRLHHLYIQERAGTSTYIDTRTVFLSKYLKKGNYVLVPTMFQHGRTSEFLLRIFSEVPVQLRELTLDMPKMSCWNLARGYPKVVTQITVHSAEDLEKKYANETVNPYLVIKCGKEEVRSPVQKNTVHAIFDTQAIFYRRTTDIPIIVQVWNSRKFCDQFLGQVTLDADPSDCRDLKSLYLRKKGGPTAKVKQGHISFKVISSDDLTEL

SEQ ID NO: 5462 - protein, 1059 aa, Homo sapiens
MAAVAGSGAAAAPSSLLLVVGSEFGSPGLLTYVLEELERGIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 5463 - protein, 1577 aa, Homo sapiens
MEAGSVVRAIFDFCPSVSEELPLFVGDIIEVLAVVDEFWLLGKKEDVTGQFPSSFVEIVTIPSLKEGERLFVCICEFTSQELDNLPLHRGDLVILDGIPTAGWLQGRSCWGARGFFPSSCVRELCLSSQSRQWHSQSALFQIPEYSMGQARALMGLSAQLDEELDFREGDVITIIGVPEPGWFEGELEGRRGIFPEGFVELLGPLRTVDESVSSGNQDDCIVNGEVDTPVGEEEIGPDEDEEEPGTYGVALYRFQALEPNELDFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 5464 - protein, 1061 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 5465 - protein, 1320 aa, Homo sapiens
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAVRIDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 5466 - protein, 201 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 5467 - protein, 442 aa, Homo sapiens
MRGAMELEPELLLQEARENVEAAQSYRRELGHRLEGLREARRQIKESASQTRDVLKQHFNDLKGTLGKLLDERLVTLLQEVDTIEQETIKPLDDCQKLIEHGVNTAEDLVREGEIAMLGGVGEENEKLWSFTKKASHIQLDSLPEVPLLVDVPCLSAQLDDSILNIVKDHIFKHGTVASRPPVQIEELIEKPGGIIVRWCKVDDDFTAQDYRLQFRKCTSNHFEDVYVGSETEFIVLHIDPNVDYQFRVCARGDGRQEWSPWSVPQIGHSTLVPHEWTAGFEGYSLSSRRNIALRNDSESSGVLYSRAPTYFCGQTLTFRVETVGQPDRRDSIGVCAEKQDGYDSLQRDQAVCISTNGAVFVNGKEMTNQLPAVTSGSTVTFDIEAVTLGTTSNNEGGHFKLRVTISSNNREVVFDWLLDQSCGSLYFGCSFFYPGWKVLVF

SEQ ID NO: 5468 - protein, 475 aa, Homo sapiens
MAALTTLFKYIDENQDRYIKKLAKWVAIQSVSAWPEKRGEIRRMMEVAAADVKQLGGSVELVDIGKQKLPDGSEIPLPPILLGRLGSDPQKKTVCIYGHLDVQPAALEDGWDSEPFTLVERDGKLYGRGSTDDKGPVAGWINALEAYQKTGQEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 5469 - protein, 2096 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 5470 - protein, 391 aa, Homo sapiens
MAALTTLFKYIDENQDRYIKKLAKWVAIQSVSAWPEKRGEIRRMMEVAAADVKQLGGSVELVDIGKQKEIPVNVRFCLEGMEESGSEGLDELIFARKDTFFKDVDYVCISDNYWLGKKKPCITYGLRGICYFFIEVECSNKDLHSGVYGGSVHEAMTDLILLMGSLVDKRGNILIPGINEAVAAVTEEEHKLYDDIDFDIEEFAKDVGAQILLHSHKKDILMHRWRYPSLSLHGIEGAFSGSGAKTVIPRKVVGKFSIRLVPNMTPEVVGEQVTSYLTKKFAELRSPNEFKVYMGHGGKPWVSDFSHPHYLAGRRAMKTVFGVEPDLTREGGSIPVTLTFQEATGKNVMLLPVGSADDGAHSQNEKLNRYNYIEGTKMLAAYLYEVSQLKD

SEQ ID NO: 5471 - protein, 1989 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMENSVVGSSREGCSSLPEIVCEDAAPEVHCDA

SEQ ID NO: 5472 - protein, 304 aa, Homo sapiens
MGQCVTKCKNPSSTLGSKNGDREPSNKSHSRRGAGHREEQVPPCGKPGGDILVNGTKKAEAATEACQLPTSSGDAGRESKSNAEESSLQRLEELFRRYKDEREDAILEEGMERFCNDLCVDPTEFRVLLLAWKFQAATMCKFTRKEFFDGCKAISADSIDGICARFPSLLTEAKQEDKFKDLYRFTFQFGLDSEEGQRSLHREIAIALWKLVFTQNNPPVLDQWLNFLTENPSGIKGISRDTWNMFLNFTQVIGPDLSNYSEDEAWPSLFDTFVEWEMERRKREGEGRGALSSGPEGLCPEEQT

SEQ ID NO: 5473 - protein, 637 aa, Homo sapiens
MAAMAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 5474 - protein, 346 aa, Homo sapiens
MAPGSVTSDISPSSTSTAGSSRSPESEKPGPSHGGVPPGGPSHSSLPVGRRHPPVLRMVLEALQAGEQRRGTSVAAIKLYILHKYPTVDVLRFKYLLKQALATGMRRGLLARPLNSKARGATGSFKLVPKHKKKIQPRKMAPATAPRRAGEAKGKGPKKPSEAKEDPPNVGKVKKAAKRPAKVQKPPPKPGAATEKARKQGGAAKDTRAQSGEARKVPPKPDKAMRAPSSAGGLSRKAKAKGSRSSQGDAEAYRKTKAESKSSKPTASKVKNGAASPTKKKVVAKAKAPKAGQGPNTKAAAPAKGSGSKVVPAHLSRKTEAPKGPRKAGLPIKASSSKVSSQRAEA

SEQ ID NO: 5475 - protein, 622 aa, Homo sapiens
MAMAPSPSLVQVYTSPAAVAVWEWQDGLGTWHPYSATVCSFIEQQFVQQKGQRFGLGSLAHSIPLGQADPSLAPYIIDLPSWTQFRQDTGTMRAVRRHLFPQHSAPGRGVVWEWLSDDGSWTAYEASVCDYLEQQVARGNQLVDLAPLGYNYTVNYTTHTQTNKTSSFCRSVRRQAGPPYPVTTIIAPPGHTGVACSCHQCLSGSRTGPVSGRYRHSMTNLPAYPVPQHPPHRTASVFGTHQAFAPYNKPSLSGARSAPRLNTTNAWGAAPPSLGSQPLYRSSLSHLGPQHLPPGSSTSGAVSASLPSGPSSSPGSVPATVPMQMPKPSRVQQALAGMTSVLMSAIGLPVCLSRAPQPTSPPASRLASKSHGSVKRLRKMSVKGATPKPEPEPEQVIKNYTEELKVPPDEDCIICMEKLSTASGYSDVTDSKAIGSLAVGHLTKCSHAFHLLCLLAMYCNGNKDGSLQCPSCKTIYGEKTGTQPQGKMEVLRFQMSLPGHEDCGTILIVYSIPHGIQGPEHPNPGKPFTARGFPRQCYLPDNAQGRKVLELLKVAWKRRLIFTVGTSSTTGETDTVVWNEIHHKTEMDRNITGHGYPDPNYLQNVLAELAAQGVTEDCLEQQ

SEQ ID NO: 5476 - protein, 261 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 5477 - protein, 660 aa, Homo sapiens
LSLPSVTYLLLEVIPDSMRKQEVRTGREAGQGHGTGSPAEQVKALMDLLAGKGSQGSQAPQALDRTPDAPLGPCSNDSRIQRHRKALLSKVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRWIPGQGAGAGEGAEERAEAVPSPPPSFSVSLLGLP

SEQ ID NO: 5478 - protein, 383 aa, Homo sapiens
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 5479 - protein, 791 aa, Homo sapiens
MSNQQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLDQYQQVPVEIVKSDFHKPFLGGFRHKVTGVEYHNAGTQTVPKRIPERLSIFCRDTQTVFQKKNLQQTTNTTSTQMTNIGVYVSNMTDKLVTPGKYFSAAEYHAQRLKAVIVIQTYYRQWHAKIFVENLRRQKSLRLEWETQQELRKIREKEEWIKLDYHRRHNPKTNEDFEFLYNALEFWRQEELTRINQSFTGAERKAALCELLEKETQIIASIGRHRYIAYMANQEAAIQAFLDKCSAPKIWRTPNGKTIEMDTQFTIRARELQNIYKCIMLKNISQDERLDVLLTLKHTVKEHECKLTQEILELIDREVDLMMRGVKHHNLEGLRKRIATLFFHYIKTPLFNPEVAKYLKVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEWSPWNCILLTKDEAAAHLKLTSIEEGYERSFIHKIKHKHILAKNYFSQVPVLASFILDDGEIDEIRWKYHSDTTPKIIESQRPPH

SEQ ID NO: 5480 - protein, 588 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 5481 - protein, 683 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEVEEEPEVIPGPPSESPGMLTKLQIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 5482 - protein, 645 aa, Homo sapiens
MSDKSDLKAELERKKQRLAQIREEKKRKEEERKKKEADMQQKKEPVQDDSDLDRKRRETEALLQSIGISPEPPLVQPLHFLTWDTCYFHYLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 5483 - protein, 2601 aa, Homo sapiens
MKRKVVNTHKLRLSPNEEAFILKEDYERRRKLRLLQVREQERDIALQIREDIKQRRNQQFTRLAEELRAEWEESQTQKIQNLEKLYLASLRSMGEGHRQAKENEPDLDALAQRAAERKRKADLRHKEALKVQKNQKEILLKQKTWHIKARKEALLVEKERSAKITSLPPPPPTLFENIEVKRISAVKTNSSTYHHLHTFVNRETDTKRPDARLAAEEEAKRLEELQKQAAQERMERFEKAHVRGFQAMKKIHLAQNQEKLMKELKQLQQEDLARRRQTVAQMPPQLVELPYKRSEMKEDWQRELEFAFEDMYNADRKVKGNLILHLEPEPLPTVTNQIQDEELDLSMEQENLGAAEDLPVTEAEICSSETDVPLVMKTQQIPSKVLFKKLLNKIRSQKSLWTIKSMSEDESEMITTVSEIESKAPTVESGTIASKERTLSSGQEQVVESDTLTIESGPLASEDKPLSCGTNSGKEQEINETLPITTVAQSSVLLHPQEAAARIRMSARQKQIMEIEEQKQKQLELLEQIEQQKLRLETDCFRAQLEEEKRKKTQPTGVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQVETTETLRASDILTNQALESQEHLRQFSQTETQQRDYKLVPKDSETLSRALSHDRQLISQDARKISETFGATTFQSLESQQLFSENSENISYHLTEPSSFVPLVPQHSFSSLPVKVESGKIQEPFSAMSKSTVSTSHSIISQMHDRPLLPSENITAQQGNMKALQEQLDLQKKVLQATQEAQEQLLLCKQKEVEQQTGLSVFLPLVTPDSSALLPSAKADLGRIQESSPTKNNIAVSSDHHVISQLQDKRLSLSQPILSQQNNFKFLQEQLNIQKDSLQARREAQEVLYVHKQSELDRRVCSEQAEPSFPFQVAQHTFTSLPSADTKSGKIQEQHSSKSEKGLVSCQSDIPISQDGSLSFLQQFLPLHDSLKLLQEQLTKQRDTLQARHEAQVELLLHRQRDLGDSKSGLVSSSSSPVVVQHSVASQASAKAEPRRIQELYLSEKENVGPSCHLIIPTFQDKSLSFPQHSLAQQENLTILQEQSQIQRVILGAKEGTQEFVHTESELEKRISSEQTGTSSSLSQVDESERFQECISIKSDSTIPLSHPKIPRCQERLLRVSQHMLPLQDNLEEHQAWLDTEKEAFHFSQKTQENTSSEQTGSSSFIPQLVQLSFTSLASAESGTILEPLFTESESKIFSSHLQIPQLQDRLLRISQLIQPQQDNLKALQEQLATQREAIILARQEAREELLLHQSEWEGRISPEQVDTSSLPLVPQHSFASLPLNESERNQEPCSINSDNIVSSGHSEIPTLPDGLLGLSHLVLPQQDNLIALEEHLHAQTDFLPSIEKTQKELVLSKPCKFEEKVSSEHFIQSHHGDLQALQQQLDTQKKAIRSIQEVQEELLLQRLSELEKRVSSEQVCSSSFVSQVPVADSERTQKSFPTKSNDTLPSSHREIPRLQDRLLSLSKPILPQQDNMTAQLDAQREVMYSYEKPQEELSLNKQRKLNKSESAEHTIPSLFLPKETEHSFIPLPFAEAKPKSTCELYSSQNEHAAPPSNPVIPGFQDRLLSFSQSVLTQQDNLGLQKQLDLQREVLHYSQKAQEKLLVQRQTALQQQIQKHEETLKDFFKDSQISKPTVENDLKTQKMGQLRDWFPNTQDLAGNDQENIRHADRNNSDDNHLASEDTSAKQSGEHLEKDLGRRSSKPPVAKVKCGLDLNQHELSAIQEVESPAIGRTSILGKPGIYEDRDPLRVSISREQSFFGSPLAHDPFSCLQLVGQENVCGDDYDEAVKLKESVVENHAVLSYAVEEEHAYLGPTVKPDDKAKTLSYEPLSSATVSTGSLLSYENTDLSLTDPESFSEHMDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKKTLEKLRAKNTC

SEQ ID NO: 5484 - protein, 798 aa, Homo sapiens
MAASLPGPGSRLFRTYGAADGRRQRRPGREAAQWFPPQDRRRFFNSSGSSDASIGDPSQSDDPDDPDDPDFPGSPVRRRRRRPGGRVPKDRPSLTVTPKRWKLRARPSLTVTPRRLGLRARPPQKCSTPCGPLRLPPFPSRDSGRLSPDLSVCGQPRDGDELGISASLFSSLASPCPGSPTPRDSVISIGTSACLVAASAVPSGLHLPEVSLDRASLPCSQEEATGGAKDTRMVHQTRASLRSVLFGLMNSGTPEDSEFRADGKNMRESCCKRKLVVGNGPEGPGLSSTGKRRATGQDSCQERGLQEAVRREHQEASVPKGRIVPRGIDRLERTRSSRKSKHQEATETSLLHSHRFKKGQKLGKDSFPTQDLTPLQNVCFWTKTRASFSFHKKKIVTDVSEVCSIYTTATSLSGSLLSECSNRPVMNRTSGAPSSWHSSSMYLLSPLNTLSISNKKASDAEKVYGECSQKGPVPFSHCLPTEKLQRCEKIGEGVFGEVFQTIADHTPVAIKIIAIEGPDLVNGSHQKTFEEILPEIIISKELSLLSGEVCNRTEGFIGLNSVHCVQGSYPPLLLKAWDHYNSTKGSANDRPDFFKDDQLFIVLEFEFGGIDLEQMRTKLSSLATAKSILHQLTASLAVAEASLRFEHRDLHWGNVLLKKTSLKKLHYTLNGKSSTIPSCGLQVSIIDYTLSRLERDGIVVFCDVSMDEDLFTGDGDYQFDIYRLMKKENNNRWGEYHPYSNVLWLHYLTDKMLKQMTFKTKCNTPAMKQIKRKIQEFHRTMLNFSSATDLLCQHSLFK

SEQ ID NO: 5485 - protein, 254 aa, Homo sapiens
MVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 5486 - protein, 358 aa, Homo sapiens
MYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 5487 - protein, 811 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 5488 - protein, 1941 aa, Homo sapiens
MKTSDLVPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 5489 - protein, 1388 aa, Homo sapiens
MAPGCKTELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQEELTKKEALIQELQHKLNQKKEEVEQKKNEYNFKMRQLEHVMDSAAEDPQSPKTPPHFQTHLAKLLETQEQEIEDGRASKTSLEHLVTKLNEDREVKNAEILRMKEQLREMENLRLESQQLIEKNWLLQGQLDDIKRQKENSDQNHPDNQQLKNEQEESIKERLAKSKIVEEMLKMKADLEEVQSALYNKEMECLRMTDEVERTQTLESKAFQEKEQLRSKLEEMYEERERTSQEMEMLRKQVECLAEENGKLVGHQNLHQKIQYVVRLKKENVRLAEETEKLRAENVFLKEKKRSES

SEQ ID NO: 5490 - protein, 1588 aa, Homo sapiens
MLPPKHLSATKPKKSWAPNLYELDSDLTKEPDVIIGEGPTDSEFFHQRFRNLIYVEFVGPRKTLIKLRNLCLDWLQPETRTKEEIIELLVLEQYLTIIPEKLKPWVRAKKPENCEKLVTLLENYKEMYQPEDDNNSDVTSDDDMTRNRRESSPPHSVHSFSDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLVQLAEDDGHSHMTQGHSSRSKRSAYPSTSRGLKTMPEAKKSTHRRGICEDESSHGVIMEKFIKDVSRSSKSGRARESSDRSQRFPRMSDDNWKDISLNKRESVIQQRVYEGNAFRGGFRFNSTLVSRKRVLERKRRYHFDTDGKGSIHDQKGCPRKKPFECGSEMRKAMSVSSLSSLSSPSFTESQPIDFGAMPYVCDECGRSFSVISEFVEHQIMHTRENLYEYGESFIHSVAVSEVQKSQVGGKRFECKDCGETFNKSAALAEHRKIHARGYLVECKNQECEEAFMPSPTFSELQKIYGKDKFYECRVCKETFLHSSALIEHQKIHFGDDKDNEREHERERERERGETFRPSPALNEFQKMYGKEKMYECKVCGETFLHSSSLKEHQKIHTRGNPFENKGKVCEETFIPGQSLKRRQKTYNKEKLCDFTDGRDAFMQSSELSEHQKIHSRKNLFEGRGYEKSVIHSGPFTESQKSHTITRPLESDEDEKAFTISSNPYENQKIPTKENVYEAKSYERSVIHSLASVEAQKSHSVAGPSKPKVMAESTIQSFDAINHQRVRAGGNTSEGREYSRSVIHSLVASKPPRSHNGNELVESNEKGESSIYISDLNDKRQKIPARENPCEGGSKNRNYEDSVIQSVFRAKPQKSVPGEGSGEFKKDGEFSVPSSNVREYQKARAKKKYIEHRSNETSVIHSLPFGEQTFRPRGMLYECQECGECFAHSSDLTEHQKIHDREKPSGSRNYEWSVIRSLAPTDPQTSYAQEQYAKEQARNKCKDFRQFFATSEDLNTNQKIYDQEKSHGEESQGENTDGEETHSEETHGQETIEDPVIQGSDMEDPQKDDPDDKIYECEDCGLGFVDLTDLTDHQKVHSRKCLVDSREYTHSVIHTHSISEYQRDYTGEQLYECPKCGESFIHSSFLFEHQRIHEQDQLYSMKGCDDGFIALLPMKPRRNRAAERNPALAGSAIRCLLCGQGFIHSSALNEHMRLHREDDLLEQSQMAEEAIIPGLALTEFQRSQTEERLFECAVCGESFVNPAELADHVTVHKNEPYEYGSSYTHTSFLTEPLKGAIPFYECKDCGKSFIHSTVLTKHKELHLEEEEEDEAAAAAAAAAQEVEANVHVPQVVLRIQGLNVEAAEPEVEAAEPEVEAAEPEVEAAEPNGEAEGPDGEAAEPIGEAGQPNGEAEQPNGDADEPDGAGIEDPEERAEEPEGKAEEPEGDADEPDGVGIEDPEEGEDQEIQVEEPYYDCHECTETFTSSTAFSEHLKTHASMIIFEPANAFGECSGYIERASTSTGGANQADEKYFKCDVCGQLFNDRLSLARHQNTHTG

SEQ ID NO: 5491 - protein, 835 aa, Homo sapiens
MGNYKSRPTQTCTDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQGLSLEEMKRSLQYTPIDKYGYVSDPMSSMHFHSCRNSSSFEDSS

SEQ ID NO: 5492 - protein, 588 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 5493 - protein, 349 aa, Homo sapiens
MAIPITVLDCDLLLYGRGHRTLDRFKLDDVTDEYLMSMYGFPRQFIYYLVELLGANLSRPTQRSRAISPETQVLAALGFYTSGSFQTRMGDAIGISQASMSRCVANVTEALVERASQFIRFPADEASIQALKDEFYGLAGMPGVMGVVDCIHVAIKAPNAEDLSYVNRKGLHSLNCLMVCDIRGTLMTVETNWPGSLQDCAVLQQSSLSSQFEAGMHKDSWLLGDSSFFLRTWLMTPLHIPETPAEYRYNMAHSATHSVIEKTFRTLCSRFRCLDGSKGALQYSPEKSSHIILACCVLHNISLEHGMDVWSSPMTGPMEQPPEEEYEHMESLDLEADRIRQELMLTHFS

SEQ ID NO: 5494 - protein, 597 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEEEEEEEEQPRRRVQRKRANRDQDSSDDERALEDWVSSETSALPRPRWQALPALRERELGSSARFVYEACGARVFVQRFRLQHGLEGHTGCVNTLHFNQRGTWLASGSDDLKVVVWDWVRRQPVLDFESGHKSNVFQAKFLPNSGDSTLAMCARDGQVRVAELSATQCCKNTKRVAQHKGASHKLALEPDSPCTFLSAGEDAVVFTIDLRQDRPASKLVVTKEKEKKVGLYTIYVNPANTHQFAVGGRDQFVRIYDQRKIDENENNGVLKKFCPHHLVNSESKANITCLVYSHDGTELLASYNDEDIYLFNSSHSDGAQYVKRYKGHRNNATVKGVNFYGPKSEFVVSGSDCGHIFLWEKSSCQIIQFMEGDKGGVVNCLEPHPHLPVLATSGLDHDVKIWAPTAEASTELTGLKDVIKKNKRERDEDSLHQTDLFDSHMLWFLMHHLRQRRHHRRWREPGVGATDADSDESPSSSDTSDEEEGPDRVQCMPS

SEQ ID NO: 5495 - protein, 310 aa, Homo sapiens
MSQQLKKRAKTRHQKGLGGRAPSGAKPRQGKSSQDLQAEIEPVSAVWALCDGYVCYEPGPQALGGDDFSDCYIECVIRGEFSQPILEEDSLFESLEYLKKGSEQQLSQKVFEASSLECSLEYMKKGVKKELPQKIVGENSLEYSEYMTGKKLPPGGIPGIDLSDPKQLAEFARKKPPINKEYDSLSAIACPQSGCTRKLRNRAALRKHLLIHGPRDHVCAECGKAFVESSKLKRHFLVHTGEKPFRCTFEGCGKRFSLDFNLRTHVRIHTGEKRFVCPFQGCNRRFIQSNNLKAHILTHANTNKNEQEGK

SEQ ID NO: 5496 - protein, 382 aa, Homo sapiens
MLRWTVHLEGGPRRVNHAAVAVGHRVYSFGGYCSGEDYETLRQIDVHIFNAVSLRWTKLPPVKSAIRGQAPVVPYMRYGHSTVLIDDTVLLWGGRNDTEGACNVLYAFDVNTHKWFTPRVSGTVPGARDGHSACVLGKIMYIFGGYEQQADCFSNDIHKLDTSTMTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 5497 - protein, 608 aa, Homo sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 5498 - protein, 970 aa, Homo sapiens
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKNLTENQEALAKEMRADADAYRRKVDLEEHMFHKLIEAGETQSQKTQKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 5499 - protein, 215 aa, Homo sapiens
MSCTIEKALADAKALVERLRDHDDAAESLIEQTTALNKRVEAMKQYQEEIQELNEVARHRPRSTLVMGIQQENRQIRELQQENKELRTSLEEHQSALELIMSKYREQMFRLLMASKKDDPGIIMKLKEQHSKELQAHVDQITEMAAVMRKAIEIDEQQGCKEQERIFQLEQENKGLREILQITRESFLNLRKDDASESTSLSALVTNSDLSLRKS

SEQ ID NO: 5500 - protein, 891 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESEPVIQVNSWVGINSNDDQLFAVKNNFPASVHTTRYSRNDLHLEDIQTDEDKLNCSLLSSESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQKWGLAILPRPVSNFWAQAVFPPQPPKVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 5501 - protein, 275 aa, Homo sapiens
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQVGDLIYGQFVVANKDMEPEMVCIDSCGRANGMGVIGQDGLLFKVTLGLIRKLLAPDCEIIQEVGKLYPLEIVFGMNGRIWVKAKTIQQTLILANILEACEHMTSDQRKQIFSRLAES

SEQ ID NO: 5502 - protein, 539 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 5503 - protein, 410 aa, Homo sapiens
MFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 5504 - protein, 321 aa, Homo sapiens
MRALAALSAPPNERLLPRDPAATRDPDAARPARRSAVERLAADRAKYVRGRPGTGRGVASEGSGPGAIKCPGNDPGPPARAPAPVARRAIARKPLRPDSLIIYRQKCEFVRGSGADGPRASLVKKLFQGPGKDKAPVPRTGDEGKAGNPETVPTTPGPAADPAIPETPAPAARSAAPSSVPAAPPGPEPRVVRRRGLQRSQSDLSSRYSAALAESDTFFQYCGLDPEVVEALGRENFTAGSDCVTLKVRSVSVATSGSGFSRHSGGDDEGLQEEELIEQVPSTTSVIERNARIIKWLYTCKKAKETPSQEQSRTRGSKPSR

SEQ ID NO: 5505 - protein, 314 aa, Homo sapiens
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 5506 - protein, 1314 aa, Homo sapiens
MASKGAGMSFSRKSYRLTSDAEKSRVTGIVQEKLLNDYLNRIFSSSEHAPPAATSRKPLNFQNLPEHLDQLLQVDNEEEESQGQVEGRLGPSTVVLDHTGGFEGLLLVDDDLLGVIGHSNFGTIRSTTCVYKGKWLYEVLISSQGLMQIGWCTISCRFNQEEGVGDTHNSYAYDGNRVRKWNVTTTNYGKAWAAGDIVSCLIDLDDGTLSFCLNGVSLGTAFENLSRGLGMAYFPAISLSFKESVAFNFGSRPLRYPVAGYRPLQDPPSADLVRAQRLLGCFRAVLSVELDPVEGRLLDKESSKWRLRGQPTVLLTLAHIFHHFAPLLRKVYLVEAVLMSFLLGIVEKGTPTQAQSVVHQVLDLLWLFMEDYEVQDCLKQLMMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 5507 - protein, 881 aa, Homo sapiens
MAGAAPRVRYLAGFCCPLGGLAAGKPRVLCHEAEVFLSTGSELVYVYDQEGGLLTAAFRFPDQVWHLELLAPRRLLYALCARRGLYCLSLDHPGRSRSTSQDDRDSEDGDQPSPVIPVDPDACILPDAALCAFTLLDSVLVTLVQGPARWKMQLFEQPCPGEDPRPGGQIGEVELSSYTPPAGVPGKPAAPHFLPVLCSVSPSGSRVPHDLLGGSGGFTLEDALFGLLFGADATLLQSPVVLCGLPDGQLCCVILKALVTSRSAPGDPNALVKILHHLEEPVIFIGALKTEPQAAEAAENFLPDEDVHCDCLVAFGHHGRMLAIKASWDESGKLVPELREYCLPGPVLCAACGGGGRVYHSTPSDLCVVDLSRGSTPLGPEQPEEGPGGLPPMLCPASLNICSVVSLSASPRTHEGGTKLLALSAKGRLMTCSLDLDSEMPGPARMTTESAGQKIKELLSGIGNISERVSFLKKAVDQRNKALTSLNEAMNVSCALLSSGTGPRPISCTTSTTWSRLQTQDVLMATCVLENSSSFSLDQGWTLCIQVLTSSCALDLDSACSAITYTIPVDQLGPGARREVTLPLGPGENGGLDLPVTVSCTLFYSLREVVGGALAPSDSEDPFLDECPSDVLPEQEGVCLPLSRHTVDMLQCLRFPGLAPPHTRAPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQATQGSSAPDLRVQYLRQIHANHETLLREVQTLRDRLCTEDEASSCATAQRLLQVYRQLRHPSLILL

SEQ ID NO: 5508 - protein, 156 aa, Homo sapiens
MGDKKSPTRPKRQPKPSSDEGYWDCSVCTFRNSAEAFKCMMCDVRKGTSTRKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 5509 - protein, 258 aa, Homo sapiens
MCALEMAVLEIQTNGDTRVTEEAIARARHSLSDPNMREFILCCLARDPARRPSAHSLLFHRVLFEVHSLKLLAAHCFIQHQYLMPENVVEEKTKAMDLHAVLAELPRPRRPPLQWRYSEVSFMELDKFLEDVRNGIYPLMNFAATRPLGLPRVLAPPPEEVQKAKTPTPEPFDSETRKVIQMQCNLERSEDKARWHLTLLLVLEDRLHRQLTYDLLPTDSAQDLASELVHYGFLHEDDRMKLAAFLESTFLKYRGTQA

SEQ ID NO: 5510 - protein, 187 aa, Homo sapiens
MLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVFFVKSLGKVKIQCLSSAEVDNVFPINVWQCGI

SEQ ID NO: 5511 - protein, 308 aa, Homo sapiens
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGTLDHMVDQVTRSVAFVQKRYPSNKGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFHRQSWEFYQVLPVQTLCQGEWKASFEELHDVDHFEIVENLTQKDNVLTQIILKTIFQ

SEQ ID NO: 5512 - protein, 486 aa, Homo sapiens
MSGSTPFQMRLVHLDLKGAPPKVSYLSEIFPLFRALGANGLLIEYEDMFPYEGPLRLLRAKYAYSPSEIKEILHLAGLNELEVIPLVQTFGHMEFVLKHTAFAHLREVGSFPCTLNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPVREGAGSFPGSNILALVTQVSLHLRSSVDALLEGNRYVTGWFSPYHRQRKLIHPVMVQHIQPAALSLLAQWSTLVQELEAALQLAFYPDAVEEWLEENVHPSLQRLQALLQDLSEVSAPPLPPTSPGRDVAQDP

SEQ ID NO: 5513 - protein, 79 aa, Homo sapiens
MSSQQQQRQQQQCPPQRAQQQQVKQPCQPPPVKCQETCAPKTKDPCAPQVKKQCPPKGTIIPAQQKCPSAQQASKSKQK

SEQ ID NO: 5514 - protein, 273 aa, Homo sapiens
MGQKVTGGIKTVDMRDPTYRPLKQELQGLDYCKPTRLDLLLDMPPVSYDVQLLHSWNNNDRSLNVFVKEDDKLIFHRHPVAQSTDAIRGKVGYTRGLHVWQITWAMRQRGTHAVVGVATADAPLHSVGYTTLVGNNHESWGWDLGRNRLYHDGKNQPSKTYPAFLEPDETFIVPDSFLVALDMDDGTLSFIVDGQYMGVAFRGLKGKKLYPVVSAVWGHCEIRMRYLNGLDPEPLPLMDLCRRSVRLALGRERLGEIHTLPLPASLKAYLLYQ

SEQ ID NO: 5515 - protein, 1104 aa, Homo sapiens
MGNAAGSAEQPAGPAAPPPKQPAPPKQPMPAAGELEERFNRALNCMNLPPDKVQLLSQYDNEKKWELICDQERFQVKNPPAAYIQKLKSYVDTGGVSRKVAADWMSNLGFKRRVQESTQVLRELETSLRTNHIGWVQEFLNEENRGLDVLLEYLAFAQCSVTYDMESTDNGASNSEKNKPLEQSVEDLSKGPPSSVPKSRHLTIKLTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 5516 - protein, 200 aa, Homo sapiens
MEEKPSKVSLKSSDRQGSDEESVHSDTRDLWTTTTLSQAQLNMPLSEVCEGFDEEGRNISKTRGWHSPGRGSLDEGYKASHKPEELDEHALVELELHRGSSMEINLGEKDTASQIEAEKSSSMSSLNIAKHMPHRAYWAEQQSRLPLPLMELMENEALEILTKALRSYQLGIGRDHFLTKELQRYIEGLKKRRSKRLYVN

SEQ ID NO: 5517 - protein, 347 aa, Homo sapiens
MKLTSEKLPKNPFYASVSQYAAKNQKFFQWKKEKTDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 5518 - protein, 1174 aa, Homo sapiens [sequence omitted]

SEQ ID NO: 5519 - protein, 744 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 5520 - protein, 120 aa, Homo sapiens
MHPPPPAAAMDFSQNSLFGYMEDLQELTIIERPVRRSLKTPEEIERLTVDEDLSDIERAVYLLSAGQDVQGTSVIANLPFLMRQNPTETLRRVLPKVRVHEDAHLFIQRVWISHMFVQRV

SEQ ID NO: 5521 - protein, 444 aa, Homo sapiens
MREIVLTQIGQCGNQIGAKFWEVISDEHAIDSAGTYHGDSHLQLERINVYYNEASGGRYVPRAVLVDLEPGTMDSVRSGPFGQVFRPDNFIFGQCGAGNNWAKGHYTEGAELMESVMDVVRKEAESCDCLQGFQLTHSLGGGTGSGMGTLLLSKIREEYPDRIINTFSILPSPKVSDTVVEPYNATLSVHQLIENADETFCIDNEALYDICSKTLKLPTPTYGDLNHLVSATMSGVTTCLRFPGQLNADLRKLAVNMVPFPRLHFFMPGFAPLTSRGSQQYRALTVAELTQQMFDAKNMMAACDPRHGRYLTAAAIFRGRMPMREVDEQMFNIQDKNSSYFADWLPNNVKTAVCDIPPRGLKMSATFIGNNTAIQELFKRVSEQFTAMFRRKAFLHWYTGEGMDEMEFTEAESNMNDLVSEYQQYQDATAEEEEDEEYAEEEVA

SEQ ID NO: 5522 - protein, 304 aa, Homo sapiens
MAKIEKNAPTMEKKPELFNIMEVDGVPTLILSKEWWEKVCNFQAKPDDLILATYPKSGTTWMHEILDMILNDGDVEKCKRAQTLDRHAFLELKFPHKEKPDLEFVLEMSSPQLIKTHLPSHLIPPSIWKENCKIVYVARNPKDCLVSYYHFHRMASFMPDPQNLEEFYEKFMSGKVVGGSWFDHVKGWWAAKDMHRILYLFYEDIKKDPKREIEKILKFLEKDISEEILNKIIYHTSFDVMKQNPMTNYTTLPTSIMDHSISPFMRKGMPGDWKNYFTVAQNEEFDKDYQKKMAGSTLTFRTEI

SEQ ID NO: 5523 - protein, 71 aa, Homo sapiens
MCGSYYGNYYGTPGYGFCGYGGLGYGYGGLGCGYGSCCGCGFRRLGCGYGYGSRSLCGYGYGCGSGSGYYY

SEQ ID NO: 5524 - protein, 697 aa, Homo sapiens
MDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGVSQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 5525 - protein, 101 aa, Homo sapiens
MSNTQAERSIIGMIDMFHKYTGRDGKIEKPSLLTMMKENFPNFLSACDKKGIHYLATVFEKKDKNEDKKIDFSEFLSLLGDIAADYHKQSHGAAPCSGGSQ

SEQ ID NO: 5526 - protein, 225 aa, Homo sapiens
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 5527 - protein, 400 aa, Homo sapiens
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVNRELKKLLVASVGDDLQYHFERLAREKNQLILENEALGRNTAQLSEQLERMSIQCDVWRSKFLASRVMADELTNSRAALQRQNRDAHGAIQDLLSEREQFRQEMIATQKLLEELLVSLQWGREQTYSPSVQPHSTAELALTNHKLAKAVNSHLLGNVGINNQKKIPSTVEFCSTPAEKMAETVLRILDPVTCKESSPDNPFFESSPTTLLATKKNIGRFHPYTRYENITFNCCNHCRGELIAL

SEQ ID NO: 5528 - protein, 244 aa, Homo sapiens
MDPGAALQRRAGGGGGLGAGSPALSGGQGRRRKQPPRPADFKLQVIIIGSRGVGKTSLMERFTDDTFCEACKSTVGVDFKIKTVELRGKKIRLQIWDTAGQERFNSITSAYYRSAKGIILVYDITKKETFDDLPKWMKMIDKYASEDAELLLVGNKLDCETDREITRQQGEKFAQQITGMRFCEASAKDNFNVDEIFLKLVDDILKKMPLDILRNELSNSILSLQPEPEIPPELPPPRPHVRCC

SEQ ID NO: 5529 - protein, 385 aa, Homo sapiens
MALPHDSNETSYLLPPNNEDWGRQTIPDFVYGQKDLMAEGIQWPRNAPGIPDALPQSPFDAALCSAWKQRVELGLFRYRLRELQTQILPGAVGFVAQLNVERGVQRRPPQTIKSVRQAFDPVQFNFNKIRPGEVLFRLHREPDLPGTLLQEDILVVINVSPLEWGHVLLVPEPARQLPQRLLPGALRAGIEAVLLSLHPGFRVGFNSLGGLASVNHLHLHGYYLAHRLPVEQAPSEPLDPGGHLHLLQDLPAPGFLFYTRGPGPDLESLISRVCRATDYLTDHEIAHNLFVTRGAPPGKTSPSSALTGVRVILWARKSSFGIKDGEAFNVALCELAGHLPVKTSQDFSSLTEAAAVALIQDCRLPPSQAEDVQAALVALMSQEEQ

SEQ ID NO: 5530 - protein, 63 aa, Homo sapiens
MLCDNFPGAVFPGCYWGSYGYPLGYSVGCGYGSTYSPVGYGFGYGYNGCGAFGYRRYSPFALY

SEQ ID NO: 5531 - protein, 360 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESMTLMLIRISLLHRLLVLDPSQKPLQSFLPDLQITMTTLSYQSCHLCQTHYQLHLLVPAPQHLKTLTLMIFPGGLKS

SEQ ID NO: 5532 - protein, 175 aa, Homo sapiens
MPKRSCPFADVAPLQLKVRVSQRELSRGVCAERYSQEVFEKTKRLLFLGAQAYLDHVWDEGCAVVHLPESPKPGPTGAPRAARGQMLIGPDGRLIRSLGQASEADPSGVASIACSSCVRAVDGKAVCGQCERALCGQCVRTCWGCGSVACTLCGLVDCSDMYEKVLCTSCAMFET

SEQ ID NO: 5533 - protein, 121 aa, Homo sapiens
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLELSPLTKEEKTAAEQFKFHMPDL

SEQ ID NO: 5534 - protein, 655 aa, Homo sapiens
MVTTLGPKMAAEWGGGVGYSGSGPGRSRWRWSGSVWVRSVLLLLGGLRASATSTPVSLGSSPPCRHHVPSDTEVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 5535 - protein, 135 aa, Homo sapiens [sequence omitted]

SEQ ID NO: 5536 - protein, 372 aa, Homo sapiens
MNHCQLPVVIDNGSGMIKAGVAGCREPQFIYPNIIGRAKGQSRAAQGGLELCVGDQAQDWRSSLFISYPVERGLITSWEDMEIMWKHIYDYNLKLKPCDGPVLITEPALNPLANRQQITEMFFEHLGVPAFYMSIQAVLALFAAGFTTGLVLNSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKCDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 5537 - protein, 1023 aa, Homo sapiens
MDANSKDKPPETKESAMNNAGNASFILGTGKIVTPQKHAELPPNPCTPDTFKSPLNFSTVTVEQLGITPESFVRNSAGKSSSYLKKCRRRSAVGARGSPETNHLIRFIARQQNIKNARKSPLAQDSPSQGSPALYRNVNTLRERISAFQSAFHSIKENEKMTGCLEFSEAGKESEMTDLTRKEGLSACQQSGFPAVLSSKRRRISYQRDSDENLTDAEGKVIGLQIFNIDTDRACAVETSVDLSEISSKLGSTQSGFLVEESLPLSELTETSNALKVADCVVGKGSSDAVSPDTFTAEVSSDAVPDVRSPATPACRRDLPTPKTFVLRSVLKKPSVKMCLESLQEHCNNLYDDDGTHPSLISNLPNCCKEKEAEDEENFEAPAFLNMRKRKRVTFGEDLSPEVFDESLPANTPLRKGGTPVCKKDFSGLSSLLLEQSPVPEPLPQPDFDDKGENLENIEPLQVSFAVLSSPNKSSISETLSGTDTFSSSNNHEKISSPKVGRITRTSNRRNQLVSVVEESVCNLLNTEVQPCKEKKINRRKSQETKCTKRALPKKSQVLKSCRKKKGKGKKSVQKSLYGERDIASKKPLLSPIPELPEVPEMTPSIPSIRRLGSGYFSSNGKLEEVKTPKNPVKRKDLLRHDPDLHMHQGYDKYDVSEFCSYIKSSSSLGNATSDEDPNTNIMNINENKNIPKAKNKSESENEPKAGTDSPVSCASVTEERVASDSPKPALTLQQGQEFSAGGQNAENLCQFFKISPDLNIKCERKDDFLGAAEGKLQCNRLMPNSQKDCHCLGDVLIENTKESKSQSEDLGRKPMESSSVVSCRDRKDRRRSMCYSDGRSLHLEKNGNHTPSSSVGSSVEISLENSELFKDLSDAIEQTFQRRNSETKVRRSTRLQKDLENEGLVWISLPLPSTSQKAKRRTICTFDSSGFESMSPIKETVSSRQKPQMAPPVSDPENSQGPAAGSSDEPGKRRKSFCISTLANTKATSQFKGYRRRSSLNGKGESSLTALERIEHNGERKQ

SEQ ID NO: 5538 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGNNFGGGGSYNDFGNYNNQSSNFGPMKGGNFGGRSSGPYGGGGQYFAKPRNQGGYGGSSSSSSYGSGRRF

SEQ ID NO: 5539 - protein, 46 aa, Homo sapiens
MCSLASGATGYSHLLKKHFHTVSLSISLILTAWFINMDLNFMDTLS

SEQ ID NO: 5540 - protein, 65 aa, Homo sapiens
MCYYSNYYGGLRYGYGVLGGGYGCGCGYGHGYGGLGCGYGRGYGGYGYGCCRPSCYGRYWSCGFY

SEQ ID NO: 5541 - protein, 2352 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 5542 - protein, 457 aa, Homo sapiens
MSGTRASNDRPPGAGGVKRGRLQQEAAATGSRVTVVLGAQWGDEGKGKVVDLLATDADIISRCQGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 5543 - protein, 531 aa, Homo sapiens
MCSLASGATGGRGAVENEEDLPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKSKKDPRSLTVTLTLNNSTQTYGLQ

SEQ ID NO: 5544 - protein, 552 aa, Homo sapiens
MSVLSPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 5545 - protein, 257 aa, Homo sapiens
MADKMDMSLDDIIKLNRSQRGGRGGGRGRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDAQRRPAQSVNRGGMTRNRGAGGFGGGGGTRRGTRGGARGRGRGAGRNSKQQLSAEELDAQLDAYNARMDTS

SEQ ID NO: 5546 - protein, 291 aa, Homo sapiens
MGVAARPPALRHWFSHSIPLAIFALLLLYLSVRSLGARSGCGPRAQPCVPGETAPFQVRQESGTLEAPERKQPPCLGPRGMLGRMMRRFHASLKPEGDVGLSPYLAGWRALVEFLTPLGSVFAFATREAFTKVTDLEARVHGPDAEHYWSLVAMAAWERRAGLLEQPGAAPRDPTRSSGSRTLLLLHRALRWSQLCLHRVATGALGGPDAGVQCSDAYRAALGPHHPWLVRQTARLAFLAFPGRRRLLELACPGATEAEARAALVRAAGTLEDVYNRTQSLLAERGLLQLA

SEQ ID NO: 5547 - protein, 1100 aa, Homo sapiens
MGNAAGSAEQPAGPAAPPPKQPAPPKQPMPAAGELEERFNRALNCMNLPPDKVQLLSQYDNEKKWELICDQERFQVKNPPAAYIQKLKSYVDTGGVSRKVAADWMSNLGFKRRVQESTQVLRELETSLRTNHIGWVQEFLNEENRGLDVLLEYLAFAQCSVTYDMESTDNGASNSEKNKPLEQSVEDLSKGPPSSVPKSRHLTIKLTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITVIKTVPFTARTGKRTSRLLCEASLGEEMPL

SEQ ID NO: 5548 - protein, 612 aa, Homo sapiens
MENQLAKSTEERTFQYQDSLPSLPVPSLEESLKKYLESVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRFVVACSAWKSCPETDAEKLVQLTFCAFHDMIQLMNSTHL

SEQ ID NO: 5549 - protein, 590 aa, Homo sapiens
MSDSPAGSNPRTPESSGSGSGGGGKRPAVPAAVSLLPPADPLRQANRLPIRVLKMLSAHTGHLLHPEYLQPLSSTPVSPIELDAKKSPLALLAQTCSQIGKPDPPPSSKLNSVAAAANGLGAEKDPGRSAPGAASAAAALKQLGDSPAEDKSSFKPYSKGSGGGDSRKDSGSSSVSSTSSSSSSSPGDKAGFRVPSAACPPFPPHGAPVSASSSSSSPGGSRGGSPHHSDCKNGGGVGGGELDKKDQEPKPSPEPAAVSRGGGGEPGAHGGAESGASGRKSEPPSALVGAGHVAPVSPYKPGHSVFPLPPSSIGYHGSIVGAYAGYPSQFVPGLDPSKSGLVGGQLSGGLGLPPGKPPSSSPLTGASPPSFLQGLCRDPYCLGGYHGASHLGGSSCSTCSAHDPAGPSLKAGGYPLVYPGHPLQPAALSSSAAQAALPGHPLYTYGFMLQNEPLPHSCNWVAASGPCDKRFATSEELLSHLRTHTALPGAEKLLAAYPGASGLGSAAAAAAAAASCHLHLPPPAAPGSPGSLSLRNPHTLGLSRYHPYGKSHLSTAGGLAVPSLPTAGPYYSPYALYGQRLASASALGYQ

SEQ ID NO: 5550 - protein, 339 aa, Homo sapiens
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 5551 - protein, 638 aa, Homo sapiens
MSALAGEDVWRCPGCGDHIAPSQIWYRTVNETWHGSCFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 5552 - protein, 201 aa, Homo sapiens
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 5553 - protein, 717 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCRCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAVYLELQNGNTQLALQIIKRNQLLPAVKTHSEVRKKPVFQPVHPIQPIQMPAFTTVQRK

SEQ ID NO: 5554 - protein, 495 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 5555 - protein, 653 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 5556 - protein, 244 aa, Homo sapiens
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 5557 - protein, 1173 aa, Homo sapiens
MAVETLSPDWEFDRVDDGSQKIHAEVQLKNYGKFLEEYTSQLRRIEDALDDSIGDVWDFNLDPIALKLLPYEQSSLLELIKTENKVLNKVITVYAALCCEIKKLKYEAETKFYNGLLFYGEGATDASMVEGDCQIQMGRFISFLQELSCFVTRCYEVVMNVVHQLAALYISNKIAPKIIETTGVHFQTMYEHLGELLTVLLTLDEIIDNHITLKDHWTMYKRLLKSVHHNPSKFGIQEEKLKPFEKFLLKLEGQLLDGMIFQACIEQQFDSLNGGVSVSKNSTFAEEFAHSIRSIFANVEAKLGEPSEIDQRDKYVGICGLFVLHFQIFRTIDKKFYKSLLDICKKVPAITLTANIIWFPDNFLIQKIPAAAKLLDRKSLQAIKIHRDTFLQQKAQSLTKDVQSYYVFVSSWMMKMESILSKEQRMDKFAEDLTNRCNVFIQGFLYAYSISTIIKTTMNLYMSMQKPMTKTSVKALCRLVELLKAIEHMFYRRSMVVADSVSHITQHLQHQALHSISVAKKRVISDKKYSEQRLDVLSALVLAENTLNGPSTKQRRLIVSLALSVGTQMKTFKDEELFPLQVVMKKLDLISELRERVQTQCDCCFLYWHRAVFPIYLDDVYENAVDAARLHYMFSALRDCVPAMMHARHLESYEILLDCYDKEIMEILNEHLLDKLCKEIEKDLRLSVHTHLKLDDRNPFKVGMKDLALFFSLNPIRFFNRFIDIRAYVTHYLDKTFYNLTTVALHDWATYSEMRNLATQRYGLVMTEAHLPSQTLEQGLDVLEIMRNIHIFVSRYLYNLNNQIFIERTSNNKHLNTINIRHIANSIRTHGTGIMNTTVNFTYQFLKKKFYIFSQFMYDEHIKSRLIKDIRFFREIKDQNDHKYPFDRAEKFNRGIRKLGVTPEGQSYLDQFRQLISQIGNAMGYVRMIRSGGLHCSSNAIRFVPDLEDIVNFEELVKEEGLAEETLKAARHLDSVLSDHTRNSAEGTEYFKMLVDVFAPEFRRPKNIHLRNFYIIVPPLTLNFVEHSISCKEKLNKKNKIGAAFTDDGFAMGVAYILKLLDQYREFDSLHWFQSVREKYLKEIRAVAKQQNVQSASQDEKLLQTMNLTQKRLDVYLQEFELLYFSLSSARIFFRADKTAAEENQEKKEKEEETKTSNGDLSDSTVSADPVVK

SEQ ID NO: 5558 - protein, 323 aa, Homo sapiens
MLRWTVHLEGGPRRVNHAAVAVGHRVYSFGGYCSGEDYETLRQIDVHIFNADTHKWFTPRVSGTVPGARDGHSACVLGKIMYIFGGYEQQADCFSNDIHKLDTSTMTWTLICTKGSPARWRDFHSATMLGSHMYVFGGRADRFGPFHSNNEIYCNRIRVFDTRTEAWLDCPPTPVLPEGRRSHSAFGYNGELYIFGGYNARLNRHFHDLWKFNPVSFTWKKIEPKGKGPCPRRRQCCCIVGDKIVLFGGTSPSPEEGLGDEFDLIDHSDLHILDFSPSLKTLCKLAVIQYNLDQSCLPHDIRWELNAMTTNSNISRPIVSSHG

SEQ ID NO: 5559 - protein, 838 aa, Homo sapiens
MTGAEIEPSAQAKPEKKAGEEVIAGPERENDVPLVVRPKVRTQATTGARPKTETKSVPAARPKTEAQAMSGARPKTEVQVMGGARPKTEAQGITGARPKTDARAVGGARSKTDAKAIPGARPKDEAQAWAQSEFGTEAVSQAEGVSQTNAVAWPLATAESGSVTKSKGLSMDRELVNVDAETFPGTQGQKGIQPWFGPGEETNMGSWCYSRPRAREEASNESGFWSADETSTASSFWTGEETSVRSWPREESNTRSRHRAKHQTNPRSRPRSKQEAYVDSWSGSEDEASNPFSFWVGENTNNLFRPRVREEANIRSKLRTNREDCFESESEDEFYKQSWVLPGEEANSRFRHRDKEDPNTALKLRAQKDVDSDRVKQEPRFEEEVIIGSWFWAEKEASLEGGASAICESEPGTEEGAIGGSAYWAEEKSSLGAVAREEAKPESEEEAIFGSWFWDRDEACFDLNPCPVYKVSDRFRDAAEELNASSRPQTWDEVTVEFKPGLFHGVGFRSTSPFGIPEEASEMLEAKPKNLELSPEGEEQESLLQPDQPSPEFTFQYDPSYRSVREIREHLRARESAESESWSCSCIQCELKIGSEEFEEFLLLMDKIRDPFIHEISKIAMGMRSASQFTRDFIRDSGVVSLIETLLNYPSSRVRTSFLENMIHMAPPYPNLNMIETFICQVCEETLAHSVDSLEQLTGIRMLRHLTMTIDYHTLIANYMSGFLSLLTTANARTKFHVLKMLLNLSENPAVAKKLFSAKALSIFVGLFNIEETNDNIQIVIKMFQNISNIIKSGKMSLIDDDFSLEPLISAFREFEELAKQLQAQIDNQNDPEVGQQS

SEQ ID NO: 5560 - protein, 882 aa, Homo sapiens
MPGRARTRARGRARRRESYQQEAPGGPRAPGSATTQEPPQLQSTPRPLQEEVPVVRPLQPRAARGGAGGGAQSQGVKEPGPEAGLHTAPLQERRIGGVFQDLVVNTRQDMKHVKDSKTGSEGTVVQLLANHFRVISRPQWVAYKYNVDYKPDIEDGNLRTILLDQHRRKFGERHIFDGNSLLLSRPLKERRVEWLSTTKDKNIVKITVEFSKELTPTSPDCLRYYNILFRRTFKLLDFEQVGRNYYTKKKAIQLYRHGTSLEIWLGYVTSVLQYENSITLCADVSHKLLRIETAYDFIKRTSAQAQTGNIREEVTNKLIGSIVLTKYNNKTYRVDDIDWKQNPEDTFNKSDGSKITYIDYYRQQHKEIVTVKKQPLLVSQGRWKKGLTGTQREPILLIPQLCHMTGLTDEICKDYSIVKELAKHTRLSPRRRHHTLKEFINTLQDNKKVRELLQLWDLKFDTNFLSVPGRVLKNANIVQGRRMVKANSQGDWSREIRELPLLNAMPLHSWLILYSRSSHREAMSLKGHLQSVTAPMGITMKPAEMIEVDGDANSYIDTLRKYTRPTLQMGMSCLLVFKVICILPNDDKRRYDSIKRYLCTKCPIPSQCVVKKTLEKVQARTIVTKIAQQMNCKMGGALWKVETDVQRTMFVGIDCFHDIVNRQKSIAGFVASTNAELTKWYSQCVIQKTGEELVKELEICLKAALDVWCKNESSMPHSVIVYRDGVGDGQLQALLDHEAKKMSTYLKTISPNNFTLAFIVVKKRINTRFFLKHGSNFQNPPPGTVIDVELTRNEWYDFFIVSQSVQDGTVTPTHYNVIYDTIGLSPDTVQRLTYCLCHMYYNLPGIIRVPAPCHYAHKLAYLVGQSIHQEPNRSLSTRLFYL

SEQ ID NO: 5561 - protein, 638 aa, Homo sapiens
MNRQVCKKSFSGRSQGFSGRSAVVSGSSRMSCVARSGGAGGGACGFRSGAGSFGSRSLYNLGSNKSISISVAAGSSRAGGFGGGRSSCGFAGGYGGGFGGSYGGGFGGGRGVGSGFGGAGGFGGAGGFGGPGVFGGPGSFGGPGGFGPGGFPGGIQEVIVNQSLLQPLNVEIDPQIGQVKAQEREQIKTLNNKFASFIDKVRFLEQQNKVLETKWELLQQQTTGSGPSSLEPCFESYISFLCKQLDSLLGERGNLEGELKSMQDLVEDFKKKYEDEINKRTAAENEFVGLKKDVDAAFMNKVELQAKVDSLTDEVSFLRTLYEMELSQMQSHASDTSVVLSMDNNRCLDLGSIIAEVRAQYEEIAQRSKSEAEALYQTKLGELQTTAGRHGDDLRNTKSEIMELNRMIQRLRAEIENVKKQNANLQTAIAEAEQRGEMALKDANAKLQDLQTALQKAKDDLARLLRDYQELMNVKLALDVEIATYRKLLEGEECRMSGECQSAVCISVVSNVTSTSGSSGSSRGVFGGVSGSGSGGYKGGSSSSSSSGYGVSGGSGSGYGGVSSGSTGGRGSSGSYQSSSSGSRLGGAGSISVSHSGMGSSSGSIQTSGGSGYKSGGGGSTSIRFSQTTSSSQHSSTK

SEQ ID NO: 5562 - protein, 359 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 5563 - protein, 962 aa, Homo sapiens
MDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQLTVLSDQQKANVEAIMLAVMKKLTYDEEYNFENEGEDEAMFVEYRKQLKLLLDRLAQVSPELLLASVRRVFSSTLQNWQTTRFMEVEVAIRLLYMLAEALPVSHGAHFSGDVSKASALQDMMRTLVTSGVSSYQHTSVTLEFFETVVRYEKFFTVEPQHIPCVLMAFLDHRGLRHSSAKVRSRTAYLFSRFVKSLNKQMNPFIEDILNRIQDLLELSPPENGHQSLLSSDDQLFIYETAGVLIVNSEYPAERKQALMRNLLTPLMEKFKILLEKLMLAQDEERQASLADCLNHAVGFASRTSKAFSNKQTVKQCGCSEVYLDCLQTFLPALSCPLQKDILRSGVRTFLHRMIICLEEEVLPFIPSASEHMLKDCEAKDLQEFIPLINQITAKFKIQVSPFLQQMFMPLLHAIFEVLLRPAEENDQSAALEKQMLRRSYFAFLQTVTGSGMSEVIANQGAENVERVLVTVIQGAVEYPDPIAQKTCFIILSKLVELWGGKDGPVGFADFVYKHIVPACFLAPLKQTFDLADAQTVLALSECAVTLKTIHLKRGPECVQYLQQEYLPSLQVAPEIIQEFCQALQQPDAKVFKNYLKVFFQRAKP

SEQ ID NO: 5564 - protein, 991 aa, Homo sapiens
MAESFFSDFGLLWYLKELRKEEFWKFKELLKQPLEKFELKPIPWAELKKASKEDVAKLLDKHYPGKQAWEVTLNLFLQINRKDLWTKAQEEMRNKLNPYRKHMKETFQLIWEKETCLHVPEHFYKETMKNEYKELNDAYTAAARRHTVVLEGPDGIGKTTLLRKVMLDWAEGNLWKDRFTFVFFLNVCEMNGIAETSLLELLSRDWPESSEKIEDIFSQPERILFIMDGFEQLKFNLQLKADLSDDWRQRQPMPIILSSLLQKKMLPESSLLIALGKLAMQKHYFMLRHPKLIKLLGFSESEKKSYFSYFFGEKSKALKVFNFVRDNGPLFILCHNPFTCWLVCTCVKQRLERGEDLEINSQNTTYLYASFLTTVFKAGSQSFPPKVNRARLKSLCALAAEGIWTYTFVFSHGDLRRNGLSESEGVMWVGMRLLQRRGDCFAFMHLCIQEFCAAMFYLLKRPKDDPNPAIGSITQLVRASVVQPQTLLTQVGIFMFGISTEEIVSMLETSFGFPLSKDLKQEITQCLESLSQCEADREAIAFQELFIGLFETQEKEFVTKVMNFFEEVFIYIGNIEHLVIASFCLKHCQHLTTLRMCVENIFPDDSGCISDYNEKLVYWRELCSMFITNKNFQILDMENTSLDDPSLAILCKALAQPVCKLRKLIFTSVYFGHDSELFKAVLHNPHLKLLSLYGTSLSQSDIRHLCETLKHPMCKIEELILGKCDISSEVCEDIASVLACNSKLKHLSLVENPLRDEGMTLLCEALKHSHCALERLMLMYCCLTSVSCDSISEVLLCSKSLSLLDLGSNALEDNGVASLCAALKHPGCSIRELWLMGCFLTSDSCKDIAAVLICNGKLKTLKLGHNEIGDTGVRQLCAALQHPHCKLECLGLQTCPITRACCDDIAAALIACKTLRSLNLDWIALDADAVVVLCEALSHPDCALQMLGLHKSGFDEETQKILMSVEEKIPHLTISHGPWIDEEYKIRGVLL

SEQ ID NO: 5565 - protein, 177 aa, Homo sapiens
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHD

SEQ ID NO: 5566 - protein, 500 aa, Homo sapiens
MVGRSCGVATQRQGGGQRPTNLALTLSSSPAHSTALPWLPPRSLQLLSGHSVPAQPTPHLPSACGGPTRVTLGEERAWRSHGSNAGGHTCLPRRTAGAGSLTPGGERGGNNAGHTVVVDGKEYDFHLLPSGIINTKAVSFIGNGVVIHLPGLFEEAEKNEKKGLKDWEKRLIISDRAHLVFDFHQAVDGLQEVQRQAQEGKNIGTTKKGIGPTYSSKAARTGLRICDLLSDFDEFSSRFKNLAHQHQSMFPTLEIDIEGQLKRLKGFAERIRPMVRDGVYFMYEALHGPPKKILVEGANAALLDIDFGTYPFVTSSNCTVGGVCTGLGIPPQNIGDVYGVVKAYTTRVGIGAFPTEQINEIGGLLQTRGHEWGVTTGRKRRCGWLDLMILRYAHMVNGFTALALTKLDILDVLGEVKVGVSYKLNGKRIPYFPANQEMLQKVEVEYETLPGWKADTTGARRWEDLPPQAQNYIRFVENHVGVAVKWVGVGKSRESMIQLF

SEQ ID NO: 5567 - protein, 155 aa, Homo sapiens
MVNSCCGSVCSDQGCGQDLCQETCCCPSCCQTTCCRTTCYRPSYSVSCCCRPQCCQSVCCQPTCCRPSCCVPTCCHPSCCISSCCRPSCCVSSCCKPQCCQSVCCQPNCCRPSCCRPCCCLRPVCGRVSCHTTCYRPACVISTCPRPVCCASSCC

SEQ ID NO: 5568 - protein, 707 aa, Homo sapiens
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSEVKHQPIFIKERLKLFEILKKDHQLLLAIYGKKGDTSNIITVRVADGQTVQGEVWKTTPYQVAAEISQELAESTVIAKVNGELWDLDRPLEGDSSLELLTFDNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILVVGEKEKIDNAVNVRTRDNKIHGEILVTSAIDKLKNLRKTRTLNAEEAF

SEQ ID NO: 5569 - protein, 271 aa, Homo sapiens
MAGLEVLFASAAPAITCRQDALVCFLHWEVVTHGYFGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPNPDHLPPPGYDDMYL

SEQ ID NO: 5570 - protein, 157 aa, Homo sapiens
MATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 5571 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 5572 - protein, 206 aa, Homo sapiens [sequence omitted]

SEQ ID NO: 5573 - protein, 2320 aa, Homo sapiens
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQLLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKEFVPRDREPNTKVRTCMHNQKDAVQMPSETLKAKMVPEKVPRRCATVAANKIKIMSNLKETISGPENVWIRKSSRKLPHRNASAAAKKKLLNVYKEDDTTINSESEKELEDINRKMLFLRGFRSWKENAQ

SEQ ID NO: 5574 - protein, 986 aa, Homo sapiens
MAESFFSDFGLLWYLKELRKEEFWKFKELLKQPLEKFELKPIPWAELKKASKEDVAKLLDKHYPGKQAWEVTLNLFLQINRKDLWTKAQEEMRNKLNPYRKHMKETFQLIWEKETCLHVPEHFYKETMKNEYKELNDAYTAAARRHTVVLEGPDGIGKTTLLRKVMLDWAEGNLWKDRFTFVFFLNVCEMNGIAETSLLELLSRDWPESSEKIEDIFSQPERILFIMDGFEQLKFNLQLKADLSDDWRQRQPMPIILSSLLQKKMLPESSLLIALGKLAMQKHYFMLRHPKLIKLLGFSESEKKSYFSYFFGEKSKALKVFNFVRDNGPLFILCHNPFTCWLVCTCVKQRLERGEDLEINSQNTTYLYASFLTTVFKAGSQSFPPKVNRARLKSLCALAAEGIWTYTFVFSHGDLRRNGLSESEGVMWVGMRLLQRRGDCFAFMHLCIQEFCAAMFYLLKRPKDDPNPAIGSITQLVRASVVQPQTLLTQVGIFMFGISTEEIVSMLETSFGFPLSKDLKQEITQCLESLSQCEADREAIAFQELFIGLFETQEKEFVTKVMNFFEEVFIYIGNIEHLVIASFCLKHCQHLTTLRMCVENIFPDDSGCISDYNEKLVYWRELCSMFITNKNFQILDMENTSLDDPSLAILCKALAQPVCKLRKLIFTSVYFGHDSELFKAVLHNPHLKLLSLYGTSLSQSDIRHLCETLKHPMCKIEELILGKCDISSEVCEDIASVLACNSKLKHLSLVENPLRDEGMTLLCEALKHSHCALERLMLMYCCLTSVSCDSISEVLLCSKSLSLLDLGSNALEDNGVASLCAALKHPGCSIRELWLMGCFLTSDSCKDIAAVLICNGKLKTLKLGHNEIGDTGVRQLCAALQHPHCKLECLGLQTCPITRACCDDIAAALIACKTLRSLNLDWIALDADAVVVLCEALSHPDCALQMLGNCQKSLGDTVAPGENHCSIKHLLLTLPINMQRQLRLQK

SEQ ID NO: 5575 - protein, 1012 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 5576 - protein, 119 aa, Homo sapiens
MVRTKTWTLKKHFVGYPTNSDFELKTAELPPLKNGEVLLEALFLTVDPYMRVVESKNVALPKGTIVLASPGWTTHSISDGKDLEKLLTEWPDTIPLSLALGTVGMPGLTAYFGLLEICG

SEQ ID NO: 5577 - protein, 598 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 5578 - protein, 617 aa, Homo sapiens
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 5579 - protein, 445 aa, Homo sapiens
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYSIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 5580 - protein, 675 aa, Homo sapiens
MAKHGADEPSSRSGSPDREGRASEDRSLLHQRLAVRELIDTEVSYLHMLQLCASDIRSRLQQLPQGDLDVLFSNIDDIIKVNSRFLHDLQETASKEEEQVQLVGNIFLEFQEELEQVYKVYCASYDQALLLVDTYRKEPELQRHIQGIVEAVVPQAGSSGLSFLLVIPLQRITRYPLLLQKILENTVPDASAYPVLQRAVSALQDVNTNINEYKMRKEVASKYTKVEQLTLRERLARINTHTLSKKTTRLSQLLKQEAGLIPRTEDKEFDDLEERFQWVSLCVTELKNNVAAYLDNLQAFLYFRPHEYNLDIPEGPAVQYCNLARDLHLEAFLKFKQRLEGLVWQPLCSLAKALLGPQNLIKKRLDKLLDFERVEEKLLEVGSVTYQEEAARHTYQALNSLLVAELPQFNQLVMQWLGQIMCTFVTLQRDLAKQVLQRAEGSMAQLPHHHVPEPAFRKLVEDALGRTSNQLRSFQETFEKVQPPPTTQPLLPGSERQVQALLSRYGPGKLYQVTSNISGTGTLDLTLPRGQIVAILQNKDTKGNSGRWLVDTGGHRGYVPAGKLQLYHVVPSAEELRRQAGLNKDPRCLTPEPSPALVPSIPTMNQVIAAYPFVARSSHEVSLQAGQPVTILEAQDKKGNPEWSLVEVNGQRGYVPSGFLARARSPVLWGWSLPS

SEQ ID NO: 5581 - protein, 1132 aa, Homo sapiens
MASDGASALPGPDMSMKPSAAPSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLQPELAAPQGTPGPLGVERRGSGKVINQVSLHQDGHLGGAGPPGHCLVADRTSEALPLCWQGGFQPESTPSLDAGLAELAPLQGQGLEKQVLGLQKGQQTGGRGVLPQGKEPLAVPWEGSSGAMWGDDRGTPMAQSYDQNPSPRAAGERDDVCLSPGVWLSSEMDAVGLELPVQIEEVIESFQVEKCVTEYQEGCQGLGSRGNISLGPGETLVPGDTESSVIPCGGTVAAAALEKRNYCSLPGPLRANSPPLRSKENQEQSCETVGHPSDLWAEGCFPLLESGDSTLGSSKETLPPTCQGNLLIMGTEDASSLPEASQEAGSRGNSFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 5582 - protein, 173 aa, Homo sapiens
MAVAVGVRAAPVLGLARALVLGLRGSQAARWRGWGTAAPGSLWALCECPAGCRELWFRGRAAWAARSERLLHPAQDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 5583 - protein, 185 aa, Homo sapiens
MVNSCCGSVCSDQGCGQDLCQETCCCPSCCQTTCCRTTCYRPSYSVSCCCRPQCCQSVCCQPTCCRPSCCVSSCCKPQCCQSVCCQPTCCHPSCCISSCCRPSCCVSSCCKPQCCQSVCCQPNCCRPSCSISSCCRPSCCESSCCRPCCCLRPVCGRVSCHTTCYRPACVISTCPRPVCCASSCC

SEQ ID NO: 5584 - protein, 83 aa, Homo sapiens
MCCNYYRNCCGGCGYGSGWSSGCGYGCGYGCGYGSGCRYGSGYGTGCGYGCGYGSGCGYGCGYSSSCCGYRPLCYRRCYSSCY

SEQ ID NO: 5585 - protein, 330 aa, Homo sapiens
MGSRKKEIALQVNISTQELWEEMLSSKGLTVVDVYQGWCGPCKPVVSLFQKMRIEVGLDLLHFALAEADRLDVLEKYRGKCEPTFLFYAGGELVAVVRGANAPLLQKTILDQLEAEKKVLAEGRERKVIKDEALSDEDECVSHGKNNGEDEDMVSSERTCTLAIIKPDAVAHGKTDEIIMKIQEAGFEILTNEERTMTEAEVRLFYQHKAGEEAFEKLVHHMCSGPSHLLILTRTEGFEDVVTTWRTVMGPRDPNVARREQPESLRAQYGTEMPFNAVHGSRDREDADRELALLFPSLKFSDKDTEAPQGGEAEATAGPTEALCFPEDVD

SEQ ID NO: 5586 - protein, 201 aa, Homo sapiens
MVSSCCGSVCSDQGCGQDLCQETCCRPSCCETTCCRTTCCRPSCCVSSCCRPQCCQSVCCQPTCSRPSCCQTTCCRTTCYRPSCCVSSCCRPQCCQPACCQPTCCRPPRCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 5587 - protein, 263 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPITKNHKDYPFHIEY

SEQ ID NO: 5588 - protein, 58 aa, Homo sapiens
MRYYGSYYRGLGYGCGGFGGLGYGCGCGGYRYGSGYGGYRYGCCRPSCREGYGFSGFY

SEQ ID NO: 5589 - protein, 52 aa, Homo sapiens
MCYGYGCGCGSFCRLGYGCGYEGCRYGCGHRGCGDGCCCPSCYRRYRFTGFY

SEQ ID NO: 5590 - protein, 84 aa, Homo sapiens
MSYYGSYYRGLGYGCGGFGGLGYGYGCGCGSFRRLGYGCGFGGNGYGYCRPSCYGGYGFSILLKSYPEDTISEVIRRSFNLTKY

SEQ ID NO: 5591 - protein, 81 aa, Homo sapiens
MSYYGSYYGGLGYGCGGFGGLGYGYGCGCGSFRRLGSGCGYGGYGYGSGFGGYGYGSGFGGYGYGCYRPSYYGGYGFSGFY

SEQ ID NO: 5592 - protein, 137 aa, Homo sapiens
MSYNCSSGNFSSCCFGSYLRYPVSTYNLFYPSNAIYSPNTCQLGSSLYNGCQETYCEPTSCQTSCTLARSYQTSCYCPKNSIFCSPRQTNYIRSLGCGNTGLGSLGCGSTGFQSLDCGSSFYHPTTFSSRNFQATCY

SEQ ID NO: 5593 - protein, 160 aa, Homo sapiens
MSYNCCSRNFSSRSFGGYLYYPGSYPSSLVYSTALCSPSTCQLRSSLYRDCQKTCWEPASCQKSCYRPRTSILCCPCQTTCSGSLGFRSSSCRSQGYGSRCCYSLGNGSSGFRFLKYGGCGFPSLSYGSRFCYPNYLASGAWQSSCYRPICGSRFYQFTC

SEQ ID NO: 5594 - protein, 227 aa, Homo sapiens
MLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEAYMKLGRNVARTFLDYYRLNPVVEKVAIPMPRLRKEKSPPYKHPLLRGPASNYPNSKGDKKSSVNHKDPSTPF

SEQ ID NO: 5595 - protein, 154 aa, Homo sapiens
MTHCCSPCCQPTCCRTTCCRTTCWKPTTVTTCSSTPCCQPSCCVSSCCQPCCRPTCCQNTCCQPTCVTSCCQPSCCSTPCCQPTCCGSSCDQSSSCAPVYCRRTCYYPTTVCLPGCLNQSCGSNCCQPCCRPACCETTCFQPTCVSSCCQPFCC

SEQ ID NO: 5596 - protein, 2353 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSAELSQGNFWDGLGSPPDSPSPGSDVYCISELNDPQYDQSLLENLFYTAPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDMTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENGITLKPFRTATTLCVPDPIFNSEHHHSLLLPAEVPVQRLLLSAFSAQGLVPGGGVQFEIWCRYYYPNVRDQKVAKGTLPLSRICAMVTTQHREDVGIQTFNLPLTPRIENRKELRNQSSGLLDVGLRYRRSPRTAEGVLAARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITDLQTITRDSQAALSSHRARSRSNKATTLPDAQDTEALQERCTMPDEPLVRAPDKGTDSPSPPPLEETSNGGRMLHESLRHAVPITRMQSSEDTEAGPAYSDEDYEEDIIEPRTLNEITTVTDKTSPWSSVISDTSEVISPQPDEVQREGPSCPSPGPFCREELMVKSSFLSSPERAVNPHLPRQGSPSQSLVACECEASKARVGGESASANPQPIPCPTLSGAQQSSTFVGWSSPQTDQNKEPKSEAPAENEAATSELGDSADSFKKLPLNLASQSRRENHKGPPIDSSDIRQRQVTTGSETSTKQSLLLPGPIVVPNFFLPPQQLEASLRMLSLSATLPPAATTDQDKSEATRGALSQRPCRPRPNSLPLNLPEEETLRIARIFSSQYSQKD

SEQ ID NO: 5597 - protein, 72 aa, Homo sapiens
MNYYGNYYGGLGYGYGGFDDLGYGYGCGCGSFRRLGYGGGYGGYGYGSGFGGYGYRSCRPSCYGGYGFSGFY

SEQ ID NO: 5598 - protein, 65 aa, Homo sapiens
MSYNCCCGNFSSHSCEGYLCYSGYSRGGSSYPSNLVYSTEPLISQHLPAGFLSLQGLSGDLLGNP

SEQ ID NO: 5599 - protein, 127 aa, Homo sapiens
MVNSCCGSVCSDQGCDQGLCQETCCRPSCCQTTCCCPSCVVSSCCRPSCSQTTCCQTTCCRPSCCHPVCCQTTCRPSCGVSSCCRPLCCQTTCRPSCGVSSCCRPLCCQTTCCRATCCRPSCCGSSC

SEQ ID NO: 5600 - protein, 105 aa, Homo sapiens
MGCCPGDCFTCCTQEQNCCEECCCQPGCCGCCGSCCGCGGSGCGGSGCGGSCCGSSCCGSGCGGCGGCGGCGGGCCGSSCCGSSCCGSGCCGPVCCQPTPICDTK

SEQ ID NO: 5601 - protein, 1304 aa, Homo sapiens
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 5602 - protein, 300 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDEHIIPLGSMAINSISKLTQLTQSSMYSLPNAPTLADLEDDTHEASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 5603 - protein, 129 aa, Homo sapiens
MMTDLKQSHSVRLNDGPFMPVLGFGTYAPDHTPKSQAAEATKVAIDVGFRHIDSAYLYQNEEEVGQAIWEKIADGTVKREEIFYTIKLWATFFRAELVHPALERSLKKLGPDYVDLFIIHVPFAMKGSS

SEQ ID NO: 5604 - protein, 418 aa, Homo sapiens
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDLRVLNLMGNPVIRQIPNYRRTVTVRLKHLTYLDDRPVFPKDRACAEAWARGGYAAEKEERQQWESRERKKITDSIEALAMIKQRAEERKRQRESQERGEMTSSDDGENVPASAEGKEEPPGDRETRQKMELFVKESFEAKDELCPEKPSGEEPPVEAKREDGDPATVTACEG

SEQ ID NO: 5605 - protein, 823 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPAEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKNQRRQQKIQGKVLHLNDICTIDHPEDSEYEAEMSLQGEVNIKSNHISQEGVMHKEYCVNQKDLNGQAKMIESVTDNQKSTEEVDMKNINMDNDLEVLTSSPTRNLNGAYLTEGSNGEVDISNGFKNLNLNAALHPDEINIEILNDSHTPGTKVYEVVNEDPETAFCTLANREVFNTDECSIQHCLYQFTRNEKLRDANKLLCEVCTRRQCNGPKANIKGERKHVYTNAKKQMLISLAPPVLTLHLKRFQQAGFNLRKVNKHIKFPEILDLAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 5606 - protein, 1067 aa, Homo sapiens
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 5607 - protein, 345 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 5608 - protein, 195 aa, Homo sapiens
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLRMMVGVNISDEQLGSIADRTIQEADQDGDSAISFTEFVKVLEKVDVEQKMSIRFLH

SEQ ID NO: 5609 - protein, 259 aa, Homo sapiens
MADACCTRTYVIAASTMSVCSSDVGHVSRVSSPSTCTGSSWQVDNCQESCCEPRSCASSCCTPSCCAPAPCLALVCAPVSCEPSPCQSGCTDSCTPSCCQQSSCQPACCTSSPCQQACCVPVCCKSNCCKPVCCVSICSGASSPCCQQSSCQSACCTFSPCQQACCVPICCKPICCVPVCSGASSLCCQKSSCQPACCTTSCCRPSSSVSLLCRPVCRPACCVPVPSCCVPASSCQPSCCHPASCLSFLCRPACSRLAC

SEQ ID NO: 5610 - protein, 56 aa, Homo sapiens
MIYYSNYYGGYGYGGLGCGYGCGYRGYGCGYGGYGGYGNGYYCPSCYGRYWSYGFY

SEQ ID NO: 5611 - protein, 298 aa, Homo sapiens
MAASTMSVCSSAYSDSWQVDDCPESCCEPPCSAPSCCAPAPSLSLVCTPVSCVSSPCCQAACEPSACQSGCTSSCTPSCCQQSSCQPACCTSSPCQQACCVPVCCKTVCCKPVCCVPVCCGAASSCCRQSSCQPACCASSSCQPACCVPVCCKPVCCVSTCSEDSSSCCQQSSCQPACCTSSSYQQACCVPVCCKTVYCKPICCVPVCSRASSSRCQQPSCQPACCTTSCCRPSSSVSLLCHPVCRSTCCVPVSSCCAPTSSCQSSCCRPASCVSLLCRPASSRLACYSLCSGKKSSC

SEQ ID NO: 5612 - protein, 188 aa, Homo sapiens
MTAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNTVHMVSSPVGMIPDIYEKEVRLMIPL

SEQ ID NO: 5613 - protein, 48 aa, Homo sapiens
MSFDNNYHGGQGYAKGGLGCSYGCGLSGYGYACYCPWCYERSWFSGCF

SEQ ID NO: 5614 - protein, 63 aa, Homo sapiens
MSYSGSYYGGLGYGCGGFGGLGYGYSCGCGSFRRLGYGCGYGGYRYSCCHPSCYGGYWSSGFY

SEQ ID NO: 5615 - protein, 62 aa, Homo sapiens
MCGSYYGNYYGDHGYGCCGYEGLGYGYGSLRCGYSSCCGYGHGYGSRFFCGCGYGCGSGYYY

SEQ ID NO: 5616 - protein, 1408 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDGFEGCSMVPTIYPLETLHNALSLRQVSEFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 5617 - protein, 234 aa, Homo sapiens
MEGASRNLASTPRVHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 5618 - protein, 178 aa, Homo sapiens
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 5619 - protein, 790 aa, Homo sapiens; identical to SEQ ID NO: 4974

SEQ ID NO: 5620 - protein, 1195 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQGDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDEYSRGVLSPGRHVRTRLYFTSESHVHSLLSVFRYGGLLDETQDADRALQTSPQPPEGPGLPRRSPLIRNRKAGSMEVLSETSSSRPGGYRLFSSSRPPTEMKQSGLGSQCTGLFSTTVLGGSSSAPNLQDYARSHGKKLPPASLKHRDELLFVPAVKRFSVSFAKHPTNGFEGCSMVPTIYPLETLHNALSLRQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 5621 - protein, 79 aa, Homo sapiens
MCCNYYGNSCGYGSGCGCGYGSGSGCGCGYGTGYGCGYGCGFGSHYGCGYGTGYGCGYGSGSGYCGYRPFCFRRCYSSC

SEQ ID NO: 5622 - protein, 588 aa, Homo sapiens
MKLEFTEKNYNSFVLQNLNRQRKRKEYWDMALSVDNHVFFAHRNVLAAVSPLVRSLISSNDMKTADELFITIDTSYLSPVTVDQLLDYFYSGKVVISEQNVEELLRGAQYFNTPRLRVHCNDFLIKSICRANCLRYLFLAELFELKEVSDVAYSGIRDNFHYWASPEGSMHFMRCPPVIFGRLLRDENLHVLNEDQALSALINWVYFRKEDREKYFKKFFNYINLNAVSNKTLVFASNKLVGMENTSSHTTLIESVLMDRKQERPCSLLVYQRKGALLDSVVILGGQKAHGQFNDGVFAYIIQENLWMKLSDMPYRAAALSATSAGRYIYISGGTTEQISGLKTAWRYDMDDNSWTKLPDLPIGLVFHTMVTCGGTVYSVGGSIAPRRYVSNIYRYDERKEVWCLAGKMSIPMDGTAVITKGDRHLYIVTGRCLVKGYISRVGVVDCFDTSTGDVVQCITFPIEFNHRPLLSFQQDNILCVHSHRQSVEINLQKVKASKTTTSVPVLPNSCPLDVSHAICSIGDSKVFVCGGVTTASDVQTKDYTINPNAFLLDQKTGKWKTLAPPPEALDCPACCLAKLPCKILQRI

SEQ ID NO: 5623 - protein, 735 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGLLPCTPRGGLPGPWINAACVCAADISPGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 5624 - protein, 125 aa, Homo sapiens
MAGAGPTMLLREENGCCSRRQSSSSAGDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 5625 - protein, 158 aa, Homo sapiens
MLLLDCNPEVDGLKHLLETGASVNAPPDPCKQSPVHLAAGSGLACFLLWQLQTGADLNQQDVLGEAPLHKAAKVGSLECLSLLVASDAQIDLCNKNGQTAEDLAWSCGFPDCAKFLTTIKCMQTIKASEHPDRNDCVAVLRQKRSLGSVENTSGKRKC

SEQ ID NO: 5626 - protein, 2903 aa, Homo sapiens
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 5627 - protein, 875 aa, Homo sapiens
MNFQAGGGQSPQQQQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 5628 - protein, 586 aa, Homo sapiens
MGGALGLRQLPICAPACRPSSGHSPWAAASPNPNQWSSRSRWCCLRRSEARRSCRPVGRAAPGPTRAMARPATSTRRSACPPLTPTPALRIAWRLLSATSRTSRMASVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 5629 - protein, 506 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKCNPRGLYLHCCLLSSVASLGTVHNELYKQQHCDREKISVCAVKRAETCFSSQFFSPLEVPREED

SEQ ID NO: 5630 - protein, 260 aa, Homo sapiens
MPRARSGRRSRGAGGREETFLRVRANRQTRLNARIGKMKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICM

SEQ ID NO: 5631 - protein, 486 aa, Homo sapiens
MAAVKTLNPKAEVARAQAALAVNISAARGLQDVLRTNLGPKGTMKMLVSGAGDIKLTKDGNVLLHEMGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 5632 - protein, 468 aa, Homo sapiens
MSFRLSGGSRRICSRTGSGRLSGGGTGFVAGNVCVGSGARSSFSCTLEGISSGGSFCNSGGGLGSGACAGFLGNEHSLLSGNEKVTMQNLNDRLASYLDHVHALEEANADLEQKIKGWYEKCEPGSSREHDHDYSRYFSVIEDLKRQIISATICNASIVLQNDNARLTADDFRLKYENELALHHSVEADTSGLRRVLDELTLCTTDLEIQCETLSEELTYLKKSHEEEMEVLQYTAGGNVNVEMNATPGVDLTVLLNNMRAEYEDLAEQNRKDAEAWFNERSATLQQQISDHEGAATAARNELTELKRNLQTLEIELQSLMAVKHSYECSLAETEGNYCNQLQQIQDQIGVMEEQLQQIRTETEGQKLEYEQLLDVKIFLEKEIDIYCNLLDGEERKSKSTCYKSKGYRPVNSGNQAKDSTEETIVKTVVEELDQIGNLLSLRVHSVEEKSSKISNITVEQRVPSKAP

SEQ ID NO: 5633 - protein, 271 aa, Homo sapiens; identical to SEQ ID NO: 5569

SEQ ID NO: 5634 - protein, 250 aa, Homo sapiens
MSENAAPDFYYVAMDFGGHGLSSHYSPGVPYYLQTFVSEIRRVVAGGVVGGMFFCTFPEMVDKLILLDTPLFLLESDEMENLLTYKRRAIEHVLQVEASQEPSHVFSLKQLLQRLLKSNSHLSEECGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 5635 - protein, 169 aa, Homo sapiens
MVFPLPTPQEPIMATPPKRRAVEATGEKVLRYETFISDVLQRDLRKVLDHRDKVYEQLAKYLQLRNVIERLQEAKHSELYMQVDLGCNFFVDTVVPDTSRIYVALGYGFFLELTLAEALKFIDRKSSLLTELSNSLTKDSMNIKAHIHMLLEGLRELQGLQNFPEKPHH

SEQ ID NO: 5636 - protein, 1058 aa, Homo sapiens
MTTVVVHVDSKAELTTLLEQWEKEHGSGQDMVPILTRMSQLIEKETEEYRKGDPDPFDDRHPGRADPECMLGHLLRILFKNDDFMNALVNAYVMTSREPPLNTAACRLLLDIMPGLETAVVFQEKEGIVENLFKWAREADQPLRTYSTGLLGGAMENQDIAANYRDENSQLVAIVLRRLRELQLQEVALRQENKRPSPRKLSSEPLLPLDEEAVDMDYGDMAVDDAEIQKSALQIIINCVCGPDNRISSIGKFISGTPRRKLPQNPKSSEHTLAKMWNVVQSNNGIKVLLSLLSIKMPITDADQIRALACKALVGLSRSSTVRQIISKLPLFSSCQIQQLMKEPVLQDKRSDHVKFCKYAAELIERVSGKPLLIGTDVSLARLQKADVVAQSRISFPEKELLLLIRNHLISKGLGETATVLTKEADLPMTAASHSSAFTPVTAAASPVSLPRTPRIANGIATRLGSHAAVGASAPSAPTAHPQPRPPQGPLALPGPSYAGNSPLIGRISFIRERPSPCNGRKIRVLRQKSDHGAYSQSPAIKKQLDRHLPSPPTLDSIITEYLREQHARCKNPVATCPPFSLFTPHQCPEPKQRRQAPINFTSRLNRRASFPKYGGVDGGCFDRHLIFSRFRPISVFREANEDESGFTCCAFSARERFLMLGTCTGQLKLYNVFSGQEEASYNCHNSAITHLEPSRDGSLLLTSATWSQPLSALWGMKSVFDMKHSFTEDHYVEFSKHSQDRVIGTKGDIAHIYDIQTGNKLLTLFNPDLANNYKRNCATFNPTDDLVLNDGVLWDVRSAQAIHKFDKFNMNISGVFHPNGLEVIINTEIWDLRTFHLLHTVPALDQCRVVFNHTGTVMYGAMLQADDEDDLMEERMKSPFGSSFRTFNATDYKPIATIDVKRNIFDLCTDTKDCYLAVIENQGSMDALNMDTVCRLYEVGRQRLAEDEDEEEDQEEEEQEEEDDDEDDDDTDDLDELDTDQLLEAELEEDDNNENAGEDGDNDFSPSDEELANLLEEGEDGEDEDSDADEEVELILGDTDSSDNSDLEDDIILSLNE

SEQ ID NO: 5637 - protein, 802 aa, Homo sapiens
MAAEALAAEAVASRLERQEEDIRWLWSEVERLRDEQLNAPYSCQAEGPCLTREVAQLRAENCDLRHRLCSLRLCLAEERSRQATLESAELEAAQEAGAQPPPSQSQDKDMKKKKMKESEADSEVKHQPIFIKERLKLFEILKKDHQLLLAIYGKKGDTSNIITVRVADGQTVQGEVWKTTPYQVAAEISQELAESTVIAKVNGELWDLDRPLEGDSSLELLTFDNEEAQAVYWHSSAHILGEAMELYYGGHLCYGPPIENGFYYDMFIEDRAVSSTELSALENICKAIIKEKQPFERLEVSKEILLEMFKYNKFKCRILNEKVNTATTTVYRCGPLIDLCKGPHVRHTGKIKTIKIFKNSSTYWEGNPEMETLQRIYGISFPDNKMMRDWEKFQEEAKNRDHRKIGKEQELFFFHDLSPGSCFFLPRGAFIYNTLTDFIREEYHKRDFTEVLSPNMYNSKLWEASGHWQHYSENMFTFEIEKDTFALKPMNCPGHCLMFAHRPRSWREMPIRFADFGVLHRNELSGTLSGLTRVRRFQQDDAHIFCTVEQIEEEIKGCLQFLQSVYSTFGFSFQLNLSTRPENFLGEIEMWNEAEKQLQNSLMDFGEPWKMNPGDGAFYGPKIDIKIKDAIGRYHQCATIQLDFQLPIRFNLTYVSKDGDDKKRPVIIHRAILGSVERMIAILSENYGGKWPFWLSPRQVMVIPVGPTCEKYALQVSSEFFEEGFMADVDLDHSCTLNKKIRNAQLAQYNFILVVGEKEKIDNAVNVRTRDNKIHGEILVTSAIDKLKNLRKTRTLNAEEAF

SEQ ID NO: 5638 - protein, 382 aa, Homo sapiens
MFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 5639 - protein, 451 aa, Homo sapiens [sequence omitted]

SEQ ID NO: 5640 - protein, 147 aa, Homo sapiens
  MOD_RES (1)..(1): Any amino acid
XTARGPEPEQMGLAPCCTQALCGLALRHHSHLQQIRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQ

SEQ ID NO: 5641 - protein, 256 aa, Homo sapiens
MATQRKHLVKDFNPYITCYICKGYLIKPTTVTECLHTFCKTCIVQHFEDSNDCPRCGNQVHETNPLEMLRLDNTLEEIIFKLVPGLREQELERESEFWKKNKPQENGQDDTSKADKPKVDEEGDENEDDKDYHRSDPQIAICLDCLRNNGQSGDNVVKGLMKKFIRCSTRVTVGTIKKFLSLKLKLPSSYELDVLCNGEIMGKDHTMEFIYMTRWRLRGENFRCLNCSASQVCSQDGPLYQSYPMVLQYRPRIDFG

SEQ ID NO: 5642 - protein, 2223 aa, Homo sapiens
MAPKKEKGGTVNTSSKIWEPSLIAAQFNQNDWQASIAFVVGNQIEDDLLIQALTVAVQVPQRKLFSMVSWQDILQQINEINTLVGSASSKKAKKPVGGNAPLYYEVLTAAKAIMDSGEKLTLPLIGKLLKFQLLQIKFKDQQRRENEKKVIEDKPKLEKDKGKAKSPKEKKAPSAKPAKGKGKDQPEANAPVKKTTQLKRRGEDDHTNRYIDDEPDDGAQHYIIVVGFNNPQLLAIMAELGIPITSVIKISSENYEPLQTHLAAVNQQQEVLLQSEDLEAEKLKKENAIKELKTFWKYLEPVLNNEKPETNLFDVARLEYMVKAADFPSDWSDGEMMLKLGTDIFENIACLMYDILDWKRQHQHYLESMQLINVPQVVNEKPVLEAMPTSEAPQPAVPAPGKKKAQYEEPQAPPPVTSVITTEVDMRYYNYLLNPIREEFISVPLILHCMLEQVVATEEDLVPPSLREPSPRADGLDHRIAAHIVSLLPSLCLSEREKKNLHDIFLSEEENESKAVPKGPLLLNYHDAHAHKKYALQDQKNFDPVQIEQEMQSKLPLWEFLQFPLPPPWNNTKRLATIHELMHFCTSDVLSWNEVERAFKVFTFESLKLSEVDEKGKLKPSGMMCGSDSEMFNIPWDNPARFAKQIRQQYVMKMNTQEAKQKADIKIKDRTLFVDQNLSMSVQDNESNREPSDPSQCDANNMKHSDLNNLKLSVPDNRQLLEQESIMKAQPQHESLEQTTNNEIKDDAVTKADSHEKKPKKMMVEADLEDIKKTQQRSLMDWSFTEHFKPKVLLQVLQEAHKQYRCVDSYYHTQDNSLLLVFHNPMNRQRLHCEYWNIALHSNVGFRNYLELVAKSIQDWITKEEAIYQESKMNEKIIRTRAELELKSSANAKLTSASKIFSIKESKSNKGISKTEISDQEKEKEKEKIPFILEGSLKAWKEEQHRLAEEERLREEKKAEKKGKEAGKKKGKDNAEKEDSRSLKKKSPYKEKSKEEQVKIQEVTEESPHQPEPKITYPFHGYNMGNIPTQISGSNYYLYPSDGGQIEVEKTMFEKGPTFIKVRVVKDNHNFMIHLNDPKEIVKKEEKGDYYLEEEEEGDEEQSLETEVSDAKNKAFSKFGSFSATLENGICLSISYYGSNGMAPEDKDPDLETILNIPSALTPTVVPVIVTVPQSKAKGKIKGKEKPKESLKEEEHPKEEEKKEEEVEPEPVLQETLDVPTFQSLNVSCPSGLLLTFIGQESTGQYVIDEEPTWDIMVRQSYPQRVKHYEFYKTVMPPAEQEASRVITSQGTVVKYMLDGSTQILFADGAVSRSPNSGLICPPSEMPATPHSGDLMDSISQQKSETIPSEITNTKKGKSHKSQSSMAHKGEIHDPPPEAVQTVTPVEVHIGTWFTTTPEGNRIGTKGLERIADLTPLLSFQATDPVNGTVMTTREDKVVIVERKDGTRIVDHADGTRITTFYQVYEDQIILPDDQETTEGPRTVTRQVKCMRVESSRYATVIANCEDSSCCATFGDGTTIIAKPQGTYQVLPPNTGSLYIDKDCSAVYCHESSSNIYYPFQKREQLRAGRYIMRHTSEVICEVLDPEGNTFQVMADGSISTILPEKKLEDDLNEKTEGYDSLSSMHLEKNHQQIYGEHVPRFFVMYADGSGMELLRDSDIEEYLSLAYKESNTVVLQEPVQEQPGTLTITVLRPFHEASPWQVKKEDTIVPPNLRSRSWETFPSVEKKTPGPPFGTQIWKGLCIESKQLVSAPGAILKSPSVLQMRQFIQHEVIKNEVKLRLQVSLKDYINYILKKEDELQEMMVKDSRTEEERGNAADLLKLVMSFPKMEETTKSHVTEVAAHLTDLFKQSLATPPKCPPDTFGKDFFEKTWRHTASSKRWKEKIDKTRKEIETTQNYLMDIKNRIIPPFFKSELNQLYQSQYNHLDSLSKKLPSFTKKNEDANETAVQDTSDLNLDFKPHKVSEQKSSSVPSLPKPEISADKKDFTAQNQTENLTKSPEEAESYEPVKIPTQSLLQDVAGQTRKEKVKLPHYLLSSKPKSQPLAKVQDSVGGKVNTSSVASAAINNAKSSLFGFHLLPSSVKFGVLKEGHTYATVVKLKNVGVDFCRFKVKQPPPSTGLKVTYKPGPVAAGMQTELNIELFATAVGEDGAKGSAHISHNIEIMTEHEVLFLPVEATVLTSSNYDKRPKDFPQGKENPMVQRTSTIYSSTLGVFMSRKVSPH

SEQ ID NO: 5643 - protein, 778 aa, Homo sapiens
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 5644 - protein, 562 aa, Homo sapiens
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 5645 - protein, 804 aa, Homo sapiens
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 5646 - protein, 903 aa, Homo sapiens
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 5647 - protein, 452 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGTEPARELGSQTLC

SEQ ID NO: 5648 - protein, 378 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYGLGSYSPAPPGCGPHFVYSLMVRLSSDVA

SEQ ID NO: 5649 - protein, 809 aa, Homo sapiens
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPTIKKEEKVLPKKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKDLIFDLGDPVRWEYMLLGTDKSQLSLTEEDDSGINDEDDVENLGKEDEDKSFDMPHSWVEQIEISPEAFETRCPNGKKVIQYKRAKLEKWAPYLNSNGLVSRLTTYEDLQCTNILEIKEWYQNREDMLELKHINKTTDLKTDYFKPGHPQALRVHSYKSMQPEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 5650 - protein, 275 aa, Homo sapiens
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 5651 - protein, 218 aa, Homo sapiens
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLAL

SEQ ID NO: 5652 - protein, 183 aa, Homo sapiens
MMQICDTYNQKHSLFNAMNRFIGAVNNMDQTVMVPSLLRDVPLADPGLDNDVGVEVGGSGGCLEERTPPVPDSGSANGSFFAPSRDMYSHYVLLKSIRNDIEWGVLHQPPPPAGSEEGSAWKSKDILVDLGHLEGADAGEEDLEQQFHYHLRGLHTVLSKLTRKANILTNRYKQEIGFGNWGH

SEQ ID NO: 5653 - protein, 122 aa, Homo sapiens
MLFAPCCHQCGEFIIGRVIKAMNNSWHPECFRCDLCQEVLADIGFVKNAGRHLCRPCHNREKARGLGKYICQKCHAIIDEQPLIFKNDPYHPDHFNCANCGQEGSDCRCTGAERGAILPAMP

SEQ ID NO: 5654 - protein, 360 aa, Homo sapiens
MDSELMHSIVGSYHKPPERVFVPSFTQNEPSQNCHPANLEVTSPKILHSPNSQEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 5655 - protein, 585 aa, Homo sapiens
MSGSTPFQMRLVHLDLKGAPPKVSYLSEIFPLFRALGANGLLIEYEDMFPYEGPLRLLRAKYAYSPSEIKEILHLAGLNELEVIPLVQTFGHMEFVLKHTAFAHLREVGSFPCTLNPHEAESLALVGAMIDQVLELHPGAQRLHIGCDEVYYLGEGEASRRWLQQEQNSTGKLCLSHMRAVASGVKARRPSVTPLVWDDMLRDLPEDQLAASGVPQLVEPVLWDYTADLDVHGKVLLMQKYRRCGFPQLWAASAFKGATGPSQAVPPVEHHLRNHVQWLQVAGSGPTDSLQGIILTGWQRYDHYSVLCELLPAGVPSLAACLQLLLRGGFDEDVKAKVENLLGISSLEKTDPVRQAPCSPPCPLLPLPFPRPWRQLFSAGLSAGRGPAPSLAATSLPLSHKSASICAALWMRCWRATGMSLAGSAPTTASGSSSTRSWFSTSSPQRSASWHSGAPSCRSWRLPCSWLSTRMPWRSGWRKTCTPACSGCKLCCRTSARCLPPRCHPPALAGTLLRTPEGRAHARGLLLEAGGALHCQMAWAIRAHVGVVPSGPAVSCPHSVPEGPGQPLGERLENTEGSSTGRPAL

SEQ ID NO: 5656 - protein, 703 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEAKEISLADLQENYIEALNKLVSENQQLQKDLMNTKSQLEISTQMCKKQNDRIFKPTHSRTTEFKNTEFKPTHGQHRHDGIKTEHYKTDLHSPRGQASDSINPMSRVLSPLSPQISPCSSTRSLTSYSLCKTHSLPSALDTNEANFSDTMSESMNDQEEFISSCSLPVSPLGSIATRFLEEEELRSHHILERLDAHIEELKRESEKTVRQFTALK

SEQ ID NO: 5657 - protein, 541 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKQGSEDNLQGTDPPPVGEEEVLL

SEQ ID NO: 5658 - protein, 820 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 5659 - protein, 793 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 5660 - protein, 488 aa, Homo sapiens
MRFHWLPTLSEPFDRNQELETCIRPLWTPSGSACETEHNKSMDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 5661 - protein, 325 aa, Homo sapiens
MGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 5662 - protein, 281 aa, Homo sapiens
MLFIFPLSLPWRPSCWKESCSTGQRQAGRSREDSVTPPPSSPWPTPPAGAMSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVDAESPEFCLGLQTLLSLKCCIDLEHGVLRLKAPFSELPFLPLYQEPGQ

SEQ ID NO: 5663 - protein, 510 aa, Homo sapiens
TGGGVAPAGQVRTATWARRARPYRKMAARTGTELASAASTTAPGSSKRRKRHPWHTVSRRPGRTPKWRLPRISARAPYRLRRLRRHTYWPPRRPVAASRCWPVGATPLGSVGGRTGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 5664 - protein, 183 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 5665 - protein, 487 aa, Homo sapiens
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 5666 - protein, 308 aa, Homo sapiens
MKRAHPEYSSSDSELDETIEVEKESADENGNLSSALGSMSPTTSSQILARKRRRGIIEKRRRDRINNSLSELRRLVPSAFEKQVMEQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 5667 - protein, 445 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSVSSYEKTQSYPTDWSDDESNNPFSSTDANGDSNPFDDDATSGTEVRVRALYDYEGQEHDELSFKAGDELTKMEDEDEQGWCKGRLDNGQVGLYPANYVEAIQ

SEQ ID NO: 5668 - protein, 415 aa, Homo sapiens
MMLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 5669 - protein, 589 aa, Homo sapiens
MSVSVHETRKSRSSTGSMNVTLFHKASHPDCVLAHLNTLRKHCMFTDVTLWAGDRAFPCHRAVLAASSRYFEAMFSHGLRESRDDTVNFQDNLHPEVLELLLDFAYSSRIAINEENAESLLEAGDMLQFHDVRDAAAEFLEKNLFPSNCLGMMLLSDAHQCRRLYEFSWRMCLVHFETVRQSEDFNSLSKDTLLDLISSDELETEDERVVFEAILQWVKHDLEPRKVHLPELLRSVRLALLPSDCLQEAVSSEALLMADERTKLIMDEALRCKTRILQNDGVVTSPCARPRKAGHTLLILGGQTFMCDKIYQVDHKAKEIIPKADLPSPRKEFSASAIGCKVYVTGGRGSENGVSKDVWVYDTVHEEWSKAAPMLIARFGHGSAELENCLYVVGGHTSLAGVFPASPSVSLKQVEKYDPGANKWMMVAPLRDGVSNAAVVSAKLKLFVFGGTSIHRDMVSKVQCYDPSENRWTIKAECPQPWRYTAAAVLGSQIFIMGGDTEFTAASAYRFDCETNQWTRIGDMTAKRMSCHALASGNKLYVVGGYFGTQRCKTLDCYDPTSDTWNCITTVPYSLIPTAFVSTWKHLPA

SEQ ID NO: 5670 - protein, 436 aa, Homo sapiens
MMGEAAVAAGPCPLREDSFTRFSSQSNVYGLAGGAGGRGELLAATLKGKVLGFRYQDLRQKIRPVAKELQFNYIPVDAEIVSIDTFNKSPPKRGLVVGITFIKDSGDKGSPFLNIYCDYEPGSEYNLDSIAQSCLNLELQFTPFQLCHAEVQVGDQLETVFLLSGNDPAIHLYKENEGLHQFEEQPVENLFPELTNLTSSVLWLDVHNFPGTSRRLSALGCQSGYVRVAHVDQRSREVLQMWSVLQDGPISRVIVFSLSAAKETKDRPLQDEYSVLVASMLEPAVVYRDLLNRGLEDQLLLPGSDQFDSVLCSLVTDVDLDGRPEVLVATYGQELLCYKYRGPESGLPEAQHGFHLLWQRSFSSPLLAMAHVDLTGDGLQELAVVSLKGVHILQHSLIQASELVLTRLRHQVEQRRRRLQGLEDGAGAGPAENAAS

SEQ ID NO: 5671 - protein, 213 aa, Homo sapiens
MLLPFIRTLPLLCYNHLLVSPDSATLSPPYSLEKMTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 5672 - protein, 220 aa, Homo sapiens
MTSGEVKTSLKNAYSSAKRLSPKMEEEGEEEDYCTPGAFELERLFWKGSPQYTHVNEVWPKLYIGDEATALDRYRLQKAGFTHVLNAAHGRWNVDTGPDYYRDMDIQYHGVEADDLPTFDLSVFFYPAAAFIDRALSDDHSKILVHCVMGRSRSATLVLAYLMIHKDMTLVDAIQQVAKNRCVLPNRGFLKQLRELDKQLVQQRRRSQRQDGEEEDGREL

SEQ ID NO: 5673 - protein, 614 aa, Homo sapiens
MSPADRCRSANTIEPATTSSLALFLLLQRDQSSRTRGLPEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5674 - protein, 400 aa, Homo sapiens
MKNEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYIESANCFRSNRVDMQPTDMHSLLLQPQPPLLQPLQPLTVTVMAGCTQPTPTMPLPLPLAMELALWRVYTEVATADLPPTEVT

SEQ ID NO: 5675 - protein, 514 aa, Homo sapiens
MDEGMEISSEGNSLIKAVHQSRLRLTRLLLEGGAYINESNDRGETPLMIACKTKHVDHQSVSKAKMVKYLLENNADPNIQDKSGKTALMHACLEKAGPEVVSLLLKSGADLSLQDHSSYSALVYAINSEDTETLKVLLSACKAKGKEVIIITTAKLPCGKHTTKQYLNMPPVDIDGCHSPATCTTPSEIDIKTASSPLSHSSETELTLFGFKDLELAGSNDDTWDPGSPVRKPALAPKGPKLPHAPPWVKSPPLLMHQNRVASLQEELQDITPEEELSYKTNGLALSKRFITRHQSIDVKDTAHLLRAFDQASSRKMSYDEINCQSYLSEGNQQCIEVPVDQDPDSNQTIFASTLRSIVQKRNLGANHYSSDSQLSAGLTPPTSEDGKALIGKKKILSPSPSQLSESKELLENIPPGPLSRRNHAVLERRGSGAFPLDHSVTQTRQGFLPPLNVNSHPPISDINVNNKICSLLSCGQKVLMPTVPIFPKEFKSKKMLLRRQSLQTEQIKQLVNF

SEQ ID NO: 5676 - protein, 557 aa, Homo sapiens
MDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKIYPLHELALWQPLHADSGFSKISKTFSFYKLETWLRSCLTGNPFGTSACLKSGKKLAWAHQVEGTTKRAKIACNTHVAPRMHRLVVMSQVYKQTLAKSSDTLAGAHVKIHRCNESFIYLLSPLRSVTIEKCRNSIFVLGPVGTTLHLHSCDNVKVIAVCHRLSISSTTGCIFHVLTPTRPLILSGNQTVTFAPFHTHYPMLEDHMARTGLATVPNYWDNPMVVCRENSDTRVFQLLPPCEFYVFIIPFEMEGDTTEIPGGLPSVYQKALGQREQKIQIWQKTVKEAHLTKDQRKQFQVLVENKFYEWLINTGHRQQLDSLVPPAAGSKQAAG

SEQ ID NO: 5677 - protein, 215 aa, Homo sapiens [sequence omitted]

SEQ ID NO: 5678 - protein, 295 aa, Homo sapiens
MELIQDTSRPPLEYVKGVPLIKYFAEALGPLQSFQARPDDLLINTYPKSGTTWVSQILDMIYQGGDLEKCNRAPIYVRVPFLEVNDPGEPSGLETLKDTPPPRLIKSHLPLALLPQTLLDQKVKVVYVARNPKDVAVSYYHFHRMEKAHPEPGTWDSFLEKFMAGEVSYGSWYQHVQEWWELSRTHPVLYLFYEDMKENPKREIQKILEFVGRSLPEETMDFMVQHTSFKEMKKNPMTNYTTVPQELMDHSISPFMRKGMAGDWKTTFTVAQNERFDADYAEKMAGCSLSFRSEL

SEQ ID NO: 5679 - protein, 455 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 5680 - protein, 140 aa, Homo sapiens
MRFRFCGDLDCPDWVLAEISTLAKMSSVKLRLLCSQVLKELLGQGIDYEKILKLTADAKFESGDVKATVAVLSFILSSAAKHSVDGESLSSELQQLGLPKEHAASLCRCYEEKQSPLQKHLRVCSLRKLKQAQTLMSSLG

SEQ ID NO: 5681 - protein, 190 aa, Homo sapiens
MTASASSFSSSQGVQQPSIYSFSQITRSLFLSNGVAANDKLLLSSNRITAIVNASVEVVNVFFEGIQYIKVPVTDARDSRLYDFFDPIADLIHTIDMRQGRTLLHCMAGVSRSASLCLAYLMKYHSMSLLDAHTWTKSRRPIIRPNNGFWEQLINYEFKLFNNNTVRMINSPVGNIPDIYEKDLRMMISM

SEQ ID NO: 5682 - protein, 1191 aa, Homo sapiens
MLRKLTIEQINDWFTIGKTVTNVELLGAPPAFPAGAAREEVQRQDVAPGAGPAAQAPALAQAPARPAAAFERSLSQRSSEVEYINKYRQLEAQELDVCRSVQPTSGPGPRPSLAKLSSVTCIPGTTYKYPDLPISRYKEEVVSLIESNSVVIIHGATGSGKSTQLPQYILDHYVQRSAYCSIVVTQPRKIGASSIARWISKERAWTLGGVVGYQVGLEKIATEDTRLIYMTTGVLLQKIVSAKSLMEFTHIIIDEVHERTEEMDFLLLVVRKLLRTNSRFVKVVLMSATISCKEFADYFAVPVQNKMNPAYIFEVEGKPHSVEEYYLNDLEHIHHSKLSPHLLEEPVITKDIYEVAVSLIQMFDDLDMKESGNKAWSGAQFVLERSSVLVFLPGLGEINYMHELLTSLVHKRLQVYPLHSSVALEEQNNVFLSPVPGYRKIILSTNIAESSVTVPDVKYVIDFCLTRTLVCDEDTNYQSLRLSWASKTSCNQRKGRAGRVSRGYCYRLVHKDFWDNSIPDHVVPEMLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELNWGRLNYIQIKRIREVAELYEELKTRISQFNMHVDSRRPVMDQEYIYKQRFILQVVLAGAFYPNYFTFGQPDEEMAVRELAGKDPKTTVVLKHIPPYGFLYYKQLQSLFRQCGQVKSIVFDGAKAFVEFSRNPTERFKTLPAVYMAIKMSQLKVSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTEESYESKVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 5683 - protein, 301 aa, Homo sapiens
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 5684 - protein, 502 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 5685 - protein, 192 aa, Homo sapiens
MGTFDLWTDYLGLAHLVRALSGKEGPETRLSPQPEPEPMLEPVSALEPMPAPESVPVPGPKDQKRSLESSPAPERLCSFCKHNGESRAIYQSHVLKDEAGRVLCPILRDYVCPQCGATRERAHTRRFCPLTGQGYTSVYSHTTRNSAGKKLVRPDKAKTQDTGHRRGGGGGAGFRGAGKSEPSPSCSPSMST

SEQ ID NO: 5686 - protein, 855 aa, Homo sapiens
MAVEDSTLQVVVRVRPPTPRELDSQRRPVVQVVDERVLVFNPEEPDGGFPGLKWGGTHDGPKKKGKDLTFVFDRVFGEAATQQDVFQHTTHSVLDSFLQGYNCSVFAYGATGAGKTHTMLGREGDPGIMYLTTVELYRRLEARQQEKHFEVLISYQEVYNEQIHDLLEPKGPLAIREDPDKGVVVQGLSFHQPASAEQLLEILTRGNRNRTQHPTDANATSSRSHAIFQIFVKQQDRVPGLTQAVQVAKMSLIDLAGSERASSTHAKGERLREGANINRSLLALINVLNALADAKGRKTHVPYRDSKLTRLLKDSLGGNCRTVMIAAISPSSLTYEDTYNTLKYADRAKEIRLSLKSNVTSLDCHISQYATICQQLQAEVAALRKKLQVYEGGGQPPPQDLPGSPKSGPPPEHLPSSPLPPHPPSQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESKPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPAGPLVLPELPLSPLCPSNRRNGKDLIRVGRALSAGNGVTKVS

SEQ ID NO: 5687 - protein, 147 aa, Homo sapiens
MWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 5688 - protein, 1108 aa, Homo sapiens
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAAAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 5689 - protein, 418 aa, Homo sapiens
METHISCLFPELLAMIFGYLDVRDKGRAAQVCTAWRDAAYHKSVWRGVEAKLHLRRANPSLFPSLQARGIRRVQILSLRRSLSYVIQGMANIESLNLSGCYNLTDNGLGHAFVQEIGSLRALNLSLCKQITDSSLGRIAQYLKGLEVLELGGCSNITNTGLLLIAWGLQRLKSLNLRSCRHLSDVGIGHLAGMTRSAAEGCLGLEQLTLQDCQKLTDLSLKHISRGLTGLRLLNLSFCGGISDAGLLHLSHMGSLRSLNLRSCDNISDTGIMHLAMGSLRLSGLDVSFCDKVGDQSLAYIAQGLDGLKSLSLCSCHISDDGINRMVRQMHGLRTLNIGQCVRITDKGLELIAEHLSQLTGIDLYGCTRITKRGLERITQLPCLKVLNLGLWQMTDSEKEARGDFSPLFTVRTRGSSRR

SEQ ID NO: 5690 - protein, 456 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 5691 - protein, 251 aa, Homo sapiens
MDMKRRIHLELRNRTPAAVRELVLDNCKSNDGKIEGLTAEFVNLEFLSLINVGLISVSNLPKLPKLKKLELSENRIFGGLDMLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDEDEDVEGDEDDDEVSEEEEEFGLDEEDEDEDEDEEEEEGGKGEKRKRETDDEGEDD

SEQ ID NO: 5692 - protein, 169 aa, Homo sapiens
MSAPPALQIREANAHLAAVHRRAAELEARLDAAERTVHAQAERLALHDQQLRAALDELGRAKDREIATLQEQLMTSEATVHSLQATVHQRDELIRQLQPRAELLQDICRRRPPLAGLLDALAEAERLGPLPASDPGHPPPGGPGPPLDNSTGEEADRDHLQPAVFGTTV

SEQ ID NO: 5693 - protein, 692 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 5694 - protein, 155 aa, Homo sapiens
MTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGKCLQW

SEQ ID NO: 5695 - protein, 133 aa, Homo sapiens
MTRGNQRELARQKNMKKQSDSVKGKRRDDGLSAAARKQSAPSSLPPGTRRSCSRSRKRQTRRRRNPSSFVASCPTLLPFACVPGASPTTLAFPPVVLTGPSTDGIPFALSLQRVPFVLPSPQVASLPLGHSRG

SEQ ID NO: 5696 - protein, 602 aa, Homo sapiens
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKSTGIGIEGFSELIQRNMKQLNYSLLCLPEDIRTRGVEDIPGYYYRDDGMQIWGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 5697 - protein, 1040 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 5698 - protein, 1287 aa, Homo sapiens
MVPGEENQLVPKEAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSFSDEQWYSFNDQHVSRITQEDIKKTHGGSSGSRGYYSSAFASSTNAYMLIYRLKDPARNAKFLEVDEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 5699 - protein, 139 aa, Homo sapiens
MPWRAGNGVGLEAQAGTQEAGPEEYCQEELGAEEEMAARAAWPVLRSVNSRELSRIIICNHSPRIVLPVWLNYYGKLLPYLTLLPGRDFRIHNFRSHPWLFRDARTHDKLLVNQTELFVPSSNVNGQPVFANITLQCIP

SEQ ID NO: 5700 - protein, 193 aa, Homo sapiens
MEGCVSNLMVCNLAYSGKLEELKESILADKSLATRTDQAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 5701 - protein, 203 aa, Homo sapiens
MSENAAPGLISELKLAVPWGHIAAKAWGSLQGPPVLCLHGWLDNASSFDRLIPLLPQDFYYVAMDFGGHGLSSHYSPGVPYYLQTFVSEIRRVVAALKWNRFSILGHSFGGVVGGMFFCTFPEMVDKLILLDTPLFLLESDEMENLLTYKRRAIEHVLQVEASQEPSHVFSLKQLLQRQRTALTSSAGSCVRIPSGSCRPMSC

SEQ ID NO: 5702 - protein, 254 aa, Homo sapiens
MPAGSMSTTGYPGVCSTTSYRTHCYIPVTSSVTLSSSDLSPTFGHCLPSSYQGNLWLLDYCQESYGEAPTCKSPSCEPKTCSTTGCDPSNSSVPCNSPSAGQVFSVCETTNVSPSPSCSPSTQTNGYVCNCHIPTRNASKACQTLRNGSNCFGQLNCLSKSFQTLNHCRLSTLGYKSYQNPCFIPSYVSPLCYISNSCQPQSYLVRNYHYSSYRPTSCRPLSYLSRSFRSLSYIPSTFPPLRYLCSGSRPLKCY

SEQ ID NO: 5703 - protein, 445 aa, Homo sapiens
MREIVHLQAGQCGNQIGAKFWEVISDEHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 5704 - protein, 249 aa, Homo sapiens
MAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 5705 - protein, 836 aa, Homo sapiens
MWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 5706 - protein, 783 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDIKTGSCSVTQAGVQWRDHGSLQCPTPGLKQSSCLSLPNLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 5707 - protein, 686 aa, Homo sapiens
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRAPPGAAGEGPGCADDEGPVRRQGKVTIKYDPKELRKHLNLEEWILEQLTRLYDCQEEEISELEIDVDELLDMESDDAWASRVKELLVDCYKPTEAFISGLLDKIRAMQKLSTPQKK

SEQ ID NO: 5708 - protein, 279 aa, Homo sapiens
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHRSRIISQNCCSAPAGLY

SEQ ID NO: 5709 - protein, 198 aa, Homo sapiens
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAPSLQHLCRLTINKCTGAIWGLPLPTRLKDYLEEYKFQV

SEQ ID NO: 5710 - protein, 189 aa, Homo sapiens
MEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPRFGYTISKPAFVFVRHLITLCALSWAKKEGRETLWTIEEGGAKMAE

SEQ ID NO: 5711 - protein, 99 aa, Homo sapiens
ALDVAVKTFPPERHVAVKCFGKKKEKKNNANSPASVSNPTVTKHAFGMEEELQREGSIETLSNSSGSTSGSIPRNFDGYRSPLPTNESQPLSLFPTGFP

SEQ ID NO: 5712 - protein, 389 aa, Homo sapiens
MERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQWDFASYDILRVIKTPEIANLALLGFGDIFALLFDNRYLYIMDLRTESLISRWPLPEYRKSKRGSSFLAGEASWLNGLDGHNDTGLVFATSMPDHSIHLVLWKEHG

SEQ ID NO: 5713 - protein, 812 aa, Homo sapiens
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTDLVHFDIPSIHIELGSTLRLSPLEHMRRHSVTDKRDSEEESESTAL

SEQ ID NO: 5714 - protein, 372 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 5715 - protein, 496 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 5716 - protein, 1944 aa, Homo sapiens
MSNFYEERTTMIAARDLQEFVPFGRDHCKHHPNALNLQLRQLQPASELWSSDGAAGLVGSLQEVTIHEKQKESWQLRKGVSEIGEDVDYDEELYVAGNMVIWSKGSKSQALAVYKAFTVDSPVQQALWCDFIISQDKSEKAYSSNEVEKCICILQSSCINMHSIEGKDYIASLPFQVANVWPTKYGLLFERSASSHEVPPGSPREPLPTMFSMLHPLDEITPLVCKSGSLFGSSRVQYVVDHAMKIVFLNTDPSIVMTYDAVQNVHSVWTLRRVKSEEENVVLKFSEQGGTPQNVATSSSLTAHLRSLSKGDSPVTSPFQNYSSIHSQSRSTSSPSLHSRSPSISNMAALSRAHSPALGVHSFSGVQRFNISSHNQSPKRHSISHSPNSNSNGSFLAPETEPIVPELCIDHLWTETITNIREKNSQASKVFITSDLCGQKFLCFLVESQLQLRCVKFQESNDKTQLIFGSVTNIPAKDAAPVEKIDTMLVLEGSGNLVLYTGVVRVGKVFIPGLPAPSLTMSNTMPRPSTPLDGVSTPKPLSKLLGSLDEVVLLSPVPELRDSSKLHDSLYNEDCTFQQLGTYIHSIRDPVHNRVTLELSNGSMVRITIPEIATSELVQTCLQAIKFILPKEIAVQMLVKWYNVHSAPGGPSYHSEWNLFVTCLMNMMGYNTDRLAWTRNFDFEGSLSPVIAPKKARPSETGSDDDWEYLLNSDYHQNVESHLLNRSLCLSPSEASQMKDEDFSQNLSLDSSTLLFTHIPAIFFVLHLVYEELKLNTLMGEGICSLVELLVQLARDLKLGPYVDHYYRDYPTLVRTTGQVCTIDPGQTGFMHHPSFFTSEPPSIYQWVSSCLKGEGMPPYPYLPGICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIHIPALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGHRRFQTGMHREKHKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 5717 - protein, 420 aa, Homo sapiens; identical to SEQ ID NO: 5350

SEQ ID NO: 5718 - protein, 418 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDLAALEKDYEEVGVDSVEAEAEEGEEY

SEQ ID NO: 5719 - protein, 138 aa, Homo sapiens
MQLPPFDMWKDYFNLSQVVWALIASRGQRLETQEIEEPSPGPPLGQDQGLGAPGANGGLGTLCNFCKHNGESRHVYSSHQLKTPDGVVVCPILRHYVCPVCGATGDQAHTLKYCPLNGGQQSLYRRSGRNSAGRRVKR

SEQ ID NO: 5720 - protein, 124 aa, Homo sapiens
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSSFSG

SEQ ID NO: 5721 - protein, 120 aa, Homo sapiens
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKGTLI

SEQ ID NO: 5722 - protein, 868 aa, Homo sapiens
MIPKSLVQAAETQRGLCEPGGKGREGRSGGKGETRPRGVGTQEGKGTIPGSPREKRGERGEGDPALLPAEDLWRLPGSKDRLRSSLLPPPGPPSSDSGPGPPSSHSGKTAQGPRTLNWARKQSARTSSNLCAWSLAMATKMAEIPSSPYEPGQRGMKDTQRGDAPQRGSPEPRILQLARVGNVYLKEESSRSGRLEAKKWIPTKFLENLSVPHVDLGGNQLWSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDRGLGLATGASGPAGPGGPGGGAGVRSYPVIPVPSKGFGLLQKLPPPLFPHPYGFPTAFGLCPKKDDPVLGAGEPKGGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 5723 - protein, 1194 aa, Homo sapiens
MHDLPPDSGARRGGRGLADHSFPAGARAPGQPPSRGAAYRRACPRDGERGGGGRPRQQVSPPRSPQREPRGGQLRTPRMRPSCSRSLESLRVGAKPPPFQRWPSDSWIRCGAHRDWDEPPPRGGRMDGWSGDRARAAAPTGLQPPGCKDHGCSSGSPFRDPAGSSVIRSGKGDRQEGPSFLRPPAVTVKKLQKWMYKGRLLSLGMKGRARGTAPKVTGTQAASPNVGALKVRENRVLSVPPDQRITLTDLFENAYGSSMKGRELEELKDNIEFRGHKPLNSITVSKKRNWLYQSTLRPLNLEEENKKCQDRSHLSISPVSLPKHQLSQSFLKSSKEYCTYVVCNATNSSLSKNCALDFNEENDADDEGEIWYNPIPEDDDLGISSALSFGEADSAVLKLPAVNLSMLSGSDLMKAERHTEDSLCSSEHAGDIQTTRSNGMNPIHPAHSTEFVQQYKQKLGHKTQEGIMVEDSPMLKSPFAGSGILAATNSTELGIMEPSSPNPSPVKKGSSINWSLPDKIKSPRTVRKLSMKMKKLPEFSRKLSVKGTLNYINSPDNTPSLSKYNCREVHHTDILPSGNTTTAAKRNVISRYHLDTSVSSQQSYQKKNSMSSKYSCKGGYLSDGDSPELTTKASKHGSENKFGKGKEIISNSCSKNEIDIDAFRHYSFSDQPKCSQYISGLMSVHFYGAEDLKPPRIDSKDVFCAIQVDSVNKARTALLTCRTTFLDMDHTFNIEIENAQHLKLVVFSWEPTPRKNRVCCHGTVVLPTLFRVTKTHQLAVKLEPRGLIYVKVTLMEQWENSLHGLDINQEPIIFGVDIQKVVEKENIGLMVPLLIQKCIMEIEKRGCQVVGLYRLCGSAAVKKELREAFERDSKAVGLCENQYPDINVITGVLKDYLRELPSPLITKQLYEAVLDAMAKSPLKMSSNGCENDPGDSKYTVDLLDCLPEIEKATLKMLLDHLKLVASYHEVNKMTCQNLAVCFGPVLLSQRQEPSTHNNRVFTDSEELASALDFKKHIEVLHYLLQLWPVQRLTVKKSTDNLFPEQKSSLNYLRQKKERPHMLNLSGTDSSGVLRPRQNRLDSPLSNRYAGDWSSCGENYFLNTKENLNDVDYDDVPSEDRKIGENYSKMDGPEVMIEQPIPMSKECTFQTYLTMQTVESTVDRKNNLKDLQESIDTLIGNLERELNKNKLNMSF

SEQ ID NO: 5724 - protein, 450 aa, Homo sapiens
MDPGNENSATEAAAIIDLDPDFEPQSRPRSCTWPLPRPEIANQPSEPPEVEPDLGEKAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 5725 - protein, 374 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKFVQQRGTACLIRMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 5726 - protein, 542 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTEMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 5727 - protein, 261 aa, Homo sapiens
MGSRKKEIALQVNISTQELWEEMLSSKGLTVVDVYQGWCGPCKPVVSLFQKMRIEVGLDLLHFALIKDEALSDEDECVSHGKNNGEDEDMVSSERTCTLAIIKPDAVAHGKTDEIIMKIQEAGFEILTNEERTMTEAEVRLFYQHKAGEEAFEKLVHHMCSGPSHLLILTRTEGFEDVVTTWRTVMGPRDPNVARREQPESLRAQYGTEMPFNAVHGSRDREDADRELALLFPSLKFSDKDTEAPQGESSTQPRLKITDLD

SEQ ID NO: 5728 - protein, 588 aa, Homo sapiens
MEAADASRSNGSSPEARDARSPSGPSGSLENGTKADGKDAKTTNGHGGEAAEGKSLGSALKPGEGRSALFAGNEWRRPIIQFVESGDDKNSNYFSMDSMEGKRSPYAGLQLGAAKKPPVTFAEKGELRKSIFSESRKPTVSIMEPGETRRNSYPRADTGLFSRSKSGSEEVLCDSCIGNKQKAVKSCLVCQASFCELHLKPHLEGAAFRDHQLLEPIRDFEARKCPVHGKTMELFCQTDQTCICYLCMFQEHKNHSTVTVEEAKAEKETELSLQKEQLQLKIIEIEDEAEKWQKEKDRIKSFTTNEKAILEQNFRDLVRDLEKQKEEVRAALEQREQDAVDQVKVIMDALDERAKVLHEDKQTREQLHSISDSVLFLQEFGALMSNYSLPPPLPTYHVLLEGEGLGQSLGNFKDDLLNVCMRHVEKMCKADLSRNFIERNHMENGGDHRYVNNYTNSFGGEWSAPDTMKRYSMYLTPKGGVRTSYQPSSPGRFTKETTQKNFNNLYGTKGNYTSRVWEYSSSIQNSDNDLPVVQGSSSFSLKGYPSLMRSQSPKAQPQTWKSGKQTMLSHYRPFYVNKGNGIGSNEAP

SEQ ID NO: 5729 - protein, 1188 aa, Homo sapiens
MKKKQTVQGTFSKLFGKKHTTTPSTSLYATNPPWIFTQEAPEEGTGGFDGIYYGDNRFNTVSESGTATLKARPRVRPLLTFLPLNAQENHGLAVPTPSVPDDFADKEVTGTSSLVNGNLRLYSSVGDLRPGQYGQDLLIPPPPPGPAPGPPQDISEPPGGSPLPSPPSTAPPPPPLLLEPPPPPSMAPPPPPVLEALSPPHTLSSPSIPTPPDFIPPAPPLAFLAPPPPPVPAPAPPAPASPHTVGTRLFPPGGVTKWKSDVALNGRQAEATRASPPRSPAEPKGSALGPNPEPHLTFPRSFKVPPPTPVRTSSIPVQEAQEAPRKEEGATKKAPSRLPLPPSFHIRPASQVYPDRAPEPDCPGELKATAPASPRLGQSQSQADERAGTPPPAPPLPPPAPPLPPPAPPLPPAAPPLPCAQKAAHPPAGFTKTPKSSSPALKPKPNPPSPENTASSAPVDWRDPSQMEKLRNELAAYLCGSRREDRFLSHRPGPTVAPQSKEGKKGPRLPEKETLLSLPAKDTPPGVPEKSLGGSSLTETEAAPSLTLPSVDYIPQDSPTPSVRQIRNELEARLSSAAEKEAKPSIGSLPPKPRLEGGRICENGADDDKLSKPVAKNLPPQSTTLLPTTSLQPKAMLGPAIPPKATPEPAIPPKATLWPATPPKATLGPATPLKATSGPTTPLKATSGPAIASTATTLPTTTSQLMAEKDSGPAGQPEKPASQEVSTPSQARGEGSPSEATRLPTQGARSSAAFPPKTSPGGGEVPCLYKPHCHQSSLSREVAVVMPTLARGGAAGPGEPVEVKEPPGLPAKPPASAQPTDELLRHPVTGEVVERGSPMALLLAARQRAQKGRSVGAALGRSSLPGSLRDHSHQAEASSDSIFHSQGTPNSFTVVPKLPKEAEKDSPLTTEIPNKWGPRLGRDAEGTELSRRHNWTKPEPQAPVAWERVAPSNLPQGHPLPKSFSSPPSPSNKREEEEEEFNFEVIPPPPEFSNDPEPPAPALQYLGRQSSPPRNNYSDLRQLPNAGPGAPPALGFSRFPAGARYAGAGGLERFSGGGRSLIKKRLYVGEPHRGPGLPHGGTGRSLSSPNCFGPQPGGPEMRRVNSAGRAPPGGLHAPRLSLEGAARGAAEAKHKAPGSADYGFAPAAGRSPYTTTRYGSPINTFTVRPGTRHPISYVCSGAHRKATS

SEQ ID NO: 5730 - protein, 865 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESEPVIQVNSWVGINSNDDQLFAVKNNFPASVHTTRYSRNDLHLEDIQTDEDKLNCSLLSSESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 5731 - protein, 424 aa, Homo sapiens
MSVGCPEPEPPRSLTCCGPGTAPGPGAGVPLLTEDMQALTLRTLAASDVTKHYELVRELGKGTYGKVDLVVYKGTGTKMALKFVNKSKTKLKNFLREVSITNSLSSSPFIIKVFDVVFETEDCYVFAQEYAPAGDLFDIIPPQVGLPEDTVKRCVQQLGLALDFMHGRQLVHRDIKPENVLLFDRECRRVKLADFGMTRRVGCRVKRVSGTIPYTAPEVCQAGRADGLAVDTGVDVWAFGVLIFCVLTGNFPWEAASGADAFFEEFVRWQRGRLPGLPSQWRRFTEPALRMFQRLLALEPERRGPAKEVFRFLKHELTSELRRRPSHRARKPPGDRPPAAGPLRLEAPGPLKRTVLTESGSGSRPAPPAVGSVPLPVPVPVPVPVPVPVPEPGLAPQGPPGRTDGRADKSKGQVVLATAIEICV

SEQ ID NO: 5732 - protein, 543 aa, Homo sapiens
MATRRLGVGETLGALNAALGPGGPVWIKETRTRHLRSRDFLAPHRALQARFDDGQVPEHLLHALACLQGPGVAPVLRCAPTPAGLSLQLQRSAVFERVLSAVAAYATPASPASLGQRVLLHCPALRSSPCALRLSQLRTVLVADHLARALRAHGVCVRLVPAVRDPHMLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWQKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 5733 - protein, 450 aa, Homo sapiens
MGKSFANFMCKKDFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 5734 - protein, 383 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 5735 - protein, 224 aa, Homo sapiens
MPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPIGLWSWCCPPCSPQEALHTPMPRMVLVEGTMMPSEAREVILGNLATGWFVETQGP

SEQ ID NO: 5736 - protein, 1601 aa, Homo sapiens
MEAGSVVRAIFDFCPSVSEELPLFVGDIIEVLAVVDEFWLLGKKEDVTGQFPSSFVEIVTIPSLKEGERLFVCICEFTSQELDNLPLHRGDLVILDGIPTAGWLQGRSCWGARGFFPSSCVRELCLSSQSRQWHSQSALFQIPEYSMGQARALMGLSAQLDEELDFREGDVITIIGVPEPGWFEGELEGRRGIFPEGFVELLGPLRTVDESVSSGNQDDCIVNGEVDTPVGEEEIGPDEDEEEPGTYGVALYRFQALEPNELDFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLGKNSIIAEKEYAHAEESAFLTYSLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 5737 - protein, 531 aa, Homo sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 5738 - protein, 450 aa, Homo sapiens
MVVQAAVAPNRSQRLLLKIPYGSLRRRSVERMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGRQRPAGGTPPEHGWDPRGDPGRWGELQLGRLQGKLLQSWLCFPDQGWDPNANLRKLLPGIK

SEQ ID NO: 5739 - protein, 339 aa, Homo sapiens
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQRIYSSLPVEVPLNHKRFVCDLTQADRLALYDFVVEETKKKRSDSQIIENDSDLFVDLAAKINQDNSRKSPKSYLEILAEVRDYKRRRQSYRAKNVHITKKSYTEVIRDVINVHMEELSNHWQEEQEKAEDDAEKNEERRSASVDSRQSGGSYLDAECSRHRRDRSRSPHKRKRNKDKDKNCESRRRKERDGERHHSHKRRKQKI

SEQ ID NO: 5740 - protein, 2269 aa, Homo sapiens
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQLLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKGKTFTANISKTVRRQRQSKRPRLSVDDNDWEDLDYAKSKRVLRRSKIKTRNQGRRTVRYHDGDDDRSLENVLDFNGCTL

SEQ ID NO: 5741 - protein, 163 aa, Homo sapiens
MTAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNT

SEQ ID NO: 5742 - protein, 251 aa, Homo sapiens
MISTTSKETKKDTKLYCICKTPYDESKFYIGCDLCTNWYHGECVGITEKEAKKMDVYICNDCKRAQEGSSEELYCICRTPYDESQFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 5743 - protein, 166 aa, Homo sapiens
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKDGVVLVHCNAGVSRAAAIVIGFLMNSEQTSFTSAFSLVKNARPSICPNSGFMEQLRTYQEGKESNKCDRIQENSS

SEQ ID NO: 5744 - protein, 320 aa, Homo sapiens
MSKSASPKEPEQLRKLFIGGLSFETTDESLRSHFEQWGTLTDCVVMRDPNTKRSRGFGFVTYATVEEVDAAMNTTPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVKGHNCEVRKALPKQEMASASSSQRGRRGSGNFGGGRGDGFGGNDNFGRGGNFSGRGGFGGSCGGGGYGGSGDGYNGFGNDGSNFGGGGSYNDFGNYNNQSSNFGPMKGGNFGGRSSGPYGGGGQYFAKPQNQGGYGVSSSSSSYGSGRRF

SEQ ID NO: 5745 - protein, 118 aa, Homo sapiens
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 5746 - protein, 392 aa, Homo sapiens
MKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASTIFCRAQIALLPLSPASTPSPTTSGFTVGTLSETSTGGPATPTWKECPICKERFPAESDKDALEDHMDGHFFFSTQDPFTFE

SEQ ID NO: 5747 - protein, 199 aa, Homo sapiens
MTPLAPWDPKYEAKAGPRPVWGANCSSGASFSGRTLCHPSFWPLYEAASGRGLRPVAPATGHWNGQQAPPDAGFPVVCCEDVFLSDPLLPRGQRVPLYLSKAPQQMMGSLKLLPPPPIMSARVLPRPSPSRGPSTAWLSGPELIALTGLLQMSQGEPRPSSSAVGPPDHTSDPPSPCGSPSSSQGADLSLPQTPDTHCP

SEQ ID NO: 5748 - protein, 384 aa, Homo sapiens
MEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 5749 - protein, 735 aa, Homo sapiens
MAEPLLRKTFSRLRGREKLPRKKSDAKERGHPAQRPEPSPPEPEPQAPEGSQAGAEGPSSPEASRSPARGAYLQSLEPSSRRWVLGGAKPAEDTSLGPGVPGTGEPAGEIWYNPIPEEDPRPPAPEPPGPQPGSAESEGLAPQGAAPASPPTKASRTKSPGPARRLSIKMKKLPELRRRLSLRGPRAGRERERAAPAGSVISRYHLDSSVGGPGPAAGPGGTRSPRAGYLSDGDSPERPAGPPSPTSFRPYEVGPAARAPPAALWGRLSLHLYGLGGLRPAPGATPRDLCCLLQVDGEARARTGPLRGGPDFLRLDHTFHLELEAARLLRALVLAWDPGVRRHRPCAQGTVLLPTVFRGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 5750 - protein, 219 aa, Homo sapiens
MPRGRKSRRRRNARAAEENRNNRKIQASEASETPMAASVVASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 5751 - protein, 233 aa, Homo sapiens
MNLNFTSPLHPASSQRPTSFFIEDILLHKPKPLREVAPDHFASSLASRVPLLDYGYPLMPTPTLLAPHAHHPLHKGDHHHPYFLTTSGMPVPALFPHPQHAELPGKHCRRRKARTVFSDSQLSGLEKRFEIQRYLSTPERVELATALSLSETQVKTWFQNRRMKHKKQLRKSQDEPKAPDGPESPEGSPRGSEAATAAEARLSLPAGPFVLTEPEDEVDIGDEGELGSGPHVL

SEQ ID NO: 5752 - protein, 290 aa, Homo sapiens
MELPAVGEHVFAVESIEKKRIRKGRVEYLVKWRGWSPKYNTWEPEENILDPRLLIAFQNRERQEQLMGYRKRGPKPKPLVVQVPTFARRSNVLTGLQDSSTDNRAKLDLGAQGKGQGHQYELNSKKHHHHAVGLNLSHVRKRCLSETHGEREPCKKRLTARSISTPTCLGGSPAAERPADLPPAAALPQPEVILLDSDLDEPIDLRCVKTRSEAGEPPSSLQVKPETPASAAVAVAAAAAPTTTAEKPPAEAQDEPAESLSEFKPFFGNIIITDVTANCLTVTFKEYVTV

SEQ ID NO: 5753 - protein, 247 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 5754 - protein, 181 aa, Homo sapiens
MVSSCCGSVSSEQSCGLENCCRPSCCQTTCCRTTCCRPSCCKPQCCQSVCYQPTCCHPSCCISSCCRPYCCESSCCRPCCCQTTCCRTTCCRTTCCCPSCCVSSCCRPQCCQSVCCQPTCCRPSCCISSCCHPSCCESSCCRPCCCVRPVCGRVSCHTTCYRPTCVISTCPRPLCCASSCC

SEQ ID NO: 5755 - protein, 361 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTDNSEIISRNGMECQESALRITKHCYCTYYPVSSSIELPQTAC

SEQ ID NO: 5756 - protein, 338 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVFSIRGKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQALRRETHECSICLAPLSAAGGQRVGAGRRSREMALLSCSHVFHHACLLALEEFSVGDRPPFHACPLCRSCYQKKILEC

SEQ ID NO: 5757 - protein, 365 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDIETGFHRVGQAGLQLLTSSDPPALDSQSAGITGADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKNEKLEGDAALNRLFQQIYSDGSDEVKRAMNKSFMESGGTVLSTNWSDVGKRKVEINPPDDMEWKKY

SEQ ID NO: 5758 - protein, 462 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 5759 - protein, 320 aa, Homo sapiens
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 5760 - protein, 789 aa, Homo sapiens
MEDGPSNNASCFRRLTECFLSPSLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 5761 - protein, 214 aa, Homo sapiens
MDDSETGFNLKVVLVSFKQCLDEKEEVLLDPYIASWKGLVRFLNSLGTIFSFISKDVVSKLRIMERLRGGPQSEHYRSLQAMVAHELSNRLVDLERRSHHPESGCRTVLRLHRALHWLQLFLEGLRTSPEDARTSALCADSYNASLAAYHPWVVRRAVTVAFCTLPTREVFLEAMNVGPPEQAVQMLGEALPFIQRVYNVSQKLYAEHSLLDLP

SEQ ID NO: 5762 - protein, 1430 aa, Homo sapiens
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEDVAALESQPLLGFTVIQVKDENSESKVFQLLHKNMLFYVFKAEDAHSAQKWIEAFQEGTIL

SEQ ID NO: 5763 - protein, 546 aa, Homo sapiens
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 5764 - protein, 90 aa, Homo sapiens
MSTAMNFGTKSFQPRPPDKGSFPLDHLGECKSFKEKFMKCLHNNNFENALCRKESKEYLECRMERKLMLQEPLEKLGFGDLTSGKSEAKK

SEQ ID NO: 5765 - protein, 241 aa, Homo sapiens
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 5766 - protein, 585 aa, Homo sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 5767 - protein, 256 aa, Homo sapiens
MASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 5768 - protein, 1430 aa, Homo sapiens
MCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFEKKDKEETVFQVSYPSAFSKLVASRQVSPLLASQSWSSRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLRFGHKLNVSDLYKLTDTVAIREQGNGRLVCLLPSSQARQSPLGSSQSHDGSSTNCSPIIFEELEYHEPVCRQHCSNKDFSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVETAAAFDLQIELKFAGGYSLLLEEILEYIPPPFLSPLPSFLPPPPFFFFVFFVIFIFFIFVFVQFVVFVFFIVVFVFFIVVFVFTNDKMEECVKLTSLYLFAKNVRSLLHTYHYQQIFLHEFSMAYTKYVGETLQPKTYGHSSVEELLGAIPQVVVQFLQKNGKELSCENYLNLYAKAGRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 5769 - protein, 781 aa, Homo sapiens
MGQLRDWFPNTQDLAGNDQENIRHADRNNSDDNHLASEDTSAKQSGKPGIYEDRDPLRVSISREQSFFGSPLAHDPFSCLQLVGQENVCGDDYDEAVKLKESVVENHAVLSYAVEEEHAYLGPTVKPDDKAKTLSYEPLSSATVSTGSLLSYENTDLSLTDPESFSEHMDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKKTLEKLRAKNTC

SEQ ID NO: 5770 - protein, 170 aa, Homo sapiens
MGKRYFCDYCDRSFQDNLHNRKKHLNGLQHLKAKKVWYDMFRDAAAILLDEQNKRPCRKFLLTGQCDFGSNCRFSHMSERDLQELSIQVEEERRAREWLLDAPELPEGHLEDWLEKRAKRLSSAPSSRAEPIRTTVFQYPVGWPPVQELPPSLRAPPPGGWPLQPRVQWG

SEQ ID NO: 5771 - protein, 513 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 5772 - protein, 184 aa, Homo sapiens
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 5773 - protein, 213 aa, Homo sapiens
MLQLRDSVDSAGTSPTAVLAAGEEVGAGGGPGGGRPGAGTPLRQTLWPLSIHDPTRRARVKEYFVFRPGSIEQAVEEIRVVVRPVEDGEIQGVWLLTEREGFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 5774 - protein, 295 aa, Homo sapiens; identical to SEQ ID NO: 5678

SEQ ID NO: 5775 - protein, 1288 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 5776 - protein, 951 aa, Homo sapiens
MLGSMARKKPRNTSRLPLALNPLKSKDVLAVLAERNEAIVPVGAWVEPASPGSSEIPAYTSAYLIEEELKEQLRKKQEALKHFQKQVKYRVNQQIRLRKKQQLQKSYERAQKEGSIAMQSSATHLTSKRTSVFPNNLNVAIGSSRLPPSLMPGDGIEDEENQNELFQQQAQALSETMKQARHRLASFKTVIKKKGSVFPDDGRKSFLTREEVLSRKPASTGINTGIRGELPIKVHQGLLAAVPYQNYMENQELDYEEPDYEESSSLVTDEKGKEDLFGRGQQDQQAIHSEDKNKPFSRVQKVKFKNPLFVLMEEEEQKQLHFEGLQDILPEAQDYFLEAQGDLLETQGDLTGIQSVKPDTQAVEMKVQVTEPEGQAIEPEGQPIKTETQGIMLKAQSIELEEGSIVLKTQDFLPTNQALLTKNQDVLLKDHCVLPKDQSILLKYQDQDFLPRDQHVLHKDQDILPKYQDQNFLPKDQNFLSRDQHVLPKDQDILPKYQDQNFLPKDQNFLSRDQHVLPKDQNILPKYQGQDFLPKDQDFLSRDQHVLPKDWNILPKCQDQDFLPRDQGVLPKDQNILPICQDQDFLPRDQGYLPKDQNILPICQDRDFLPRDLHVLSNDQNILPKCQDQDFLPKYQKVHFKEPYSDMTDEKGREDFSLADYQCLPPKSQDQDDIKNQQPASFMREERVREELPLDYHQYVVPKIQDQDSPREQNKHIKLPSSFEKWEIARGNTPGVPLAYDRYQSGLSTEFQAPLAFQSDVDKEEDKKERQKQYLRHRRLFMDIEREQVKEQQRQKEQKKKIEKIKKKREQECYAAEQRILRMNFHEDPYSGEKLSEILAQLQLQEIKGTREKQQREKEYLRYVEALRAQIQEKMQLYNITLPPLCCCGPDFWDAHPDTCANNCIFYKNHRAYTRALHSFINSCDVPGGNSTLRVAIHNFASAHRRTLKNL

SEQ ID NO: 5777 - protein, 415 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRNWPSSRGPPWRASEGERTAQ

SEQ ID NO: 5778 - protein, 300 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVVRIGFMGMSLSGRTSRNIISCRGLGSQRTVQESCPSCALQMPATSTGRTLRWQATPLGSERSGGGCVAVVPGPGA

SEQ ID NO: 5779 - protein, 337 aa, Homo sapiens
MRFDTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 5780 - protein, 93 aa, Homo sapiens
MAQSGGEARPGPKTAVQIRVAIQEAEDVDELEDEEEGAETRGAGDPARYLSPGWGSASEEEPSRGHRNRSSVNSRTMLASFIVSSAPSTAPST

SEQ ID NO: 5781 - protein, 84 aa, Homo sapiens
MKVKIKCWNGVATWLWVANDENCGICRMAFNGCCPDCKVPGDDCPLVWGQCSHCFHMHCILKWLHAQQVQQHCPMCRQEWKFKE

SEQ ID NO: 5782 - protein, 203 aa, Homo sapiens; identical to SEQ ID NO: 5304

SEQ ID NO: 5783 - protein, 597 aa, Homo sapiens
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQGAYFYLAGNAKSMPADVSEALMSIFQEEGGLCSPDAAAYLARLQQTRRFQTETWA

SEQ ID NO: 5784 - protein, 619 aa, Homo sapiens
MDDQQALNSIMQDLAVLHKASRPALSLQETRKAKSSSPKKQNDVRVKFEHRGEKRILQFPRPVKLEDLRSKAKIAFGQSMDLHYTNNELVIPLTTQDDLDKAVELLDRSIHMKSLKILLVINGSTQATNLEPLPSLEDLDNTVFGAERKKRLSIIGPTSRDRSSPPPGYIPDELHQVARNGSFTSINSEGEFIPESMDQMLDPLSLSSPENSGSGSCPSLDSPLDGESYPKSRMPRAQSYPDNHQEFSDYDNPIFEKFGKGGTYPRRYHVSYHHQEYNDGRKTFPRARRTQGTSLRSPVSFSPTDHSLSTSSGSSIFTPEYDDSRIRRRGSDIDNPTLTVMDISPPSRSPRAPTNWRLGKLLGQGAFGRVYLCYDVDTGRELAVKQVQFDPDSPETSKEVNALECEIQLLKNLLHERIVQYYGCLRDPQEKTLSIFMEYMPGGSIKDQLKAYGALTENVTRKYTRQILEGVHYLHSNMIVHRDIKGANILRDSTGNVKLGDFGASKRLQTICLSGTGMKSVTGTPYWMSPEVISGEGYGRKADIWSVACTVVEMLTEKPPWAEFEAMAAIFKIATQPTNPKLPPHVSDYTRDFLKRIFVEAKLRPSADELLRHMFVHYH

SEQ ID NO: 5785 - protein, 275 aa, Homo sapiens
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLTKIDHWNNEKERILLVTDKTLLICKYDFIMLSCVQLQRIPLSAVYRICLGKFTFPGMSLDKRQGEGLRIYWGSPEEQSLLSRWNPWSTEVPYATFTEHPMKYTSEKFLEICKLSGFMSKLVPAIQNAHKNSTGSGRGKKLMVLTEPILIETYTGLMSFIGNRNKLGYSLARGSIGF

SEQ ID NO: 5786 - protein, 542 aa, Homo sapiens
MAAAAGAAAAPGSREPQDRPECGAGHPGPRYYRHPERWLLRPEAFLGPLRTRAPSAEDSQRERPAARSGPAMSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 5787 - protein, 849 aa, Homo sapiens
MSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDFFLKHYRYSWSFICTPSHSHSHSTPSSSISQDNIVGSNKNNTICPDNYQTAQLLALILELLTFCVEHHTYHIKNYIMNKDLLRRVLVLMNSKHTFLALCALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 5788 - protein, 222 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEILIRFQIQRNVIVIPGSITPSHIKENIQVFDFELTQHDMDNILSLNRNLRLAMFPITKNHKDYPFHIEY

SEQ ID NO: 5789 - protein, 359 aa, Homo sapiens
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 5790 - protein, 408 aa, Homo sapiens
MKCEHCTRKECSKKTKTDDQENVSADAPSPAQENGEKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 5791 - protein, 367 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIVPMMHSATSATVSAATTPATSVPFAATATANQIILK

SEQ ID NO: 5792 - protein, 1302 aa, Homo sapiens
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRAFNSETDSFKLAYGGHQYHASCANFWINCVEPKPPGLVLPDLL

SEQ ID NO: 5793 - protein, 336 aa, Homo sapiens
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 5794 - protein, 1005 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLRPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLFGMDLNKMTHSRLAALRVTKPYLDIGC

SEQ ID NO: 5795 - protein, 205 aa, Homo sapiens
MVSSCCGSVCSDQGCGLETCCRPSCCQTTCCRTTCCRPSCCVSSCCRPQCCQSVCCQPTCCRPSCCPSCCQTTCCRTTCCRPSCCVSSCCRPQCCQSVCCQPTCCRPSCSISSCCRPSCCVSRCCRSQCCQSVCCQPTCCRPSCCISSCCRPSCCESSCCRPCCCRPCCCLRPVCGRVSCHTTCYRPTCVISTCPRPLCCASSCC

SEQ ID NO: 5796 - protein, 190 aa, Homo sapiens
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEPMQVLFSGEATHRKYYSTTHGALLSGQREAARLIEMYRDLFQQGT

SEQ ID NO: 5797 - protein, 1314 aa, Homo sapiens
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGPSLEEKFLVSCDISTSGQEQIKLNTSEVGHKALGPGSSKKYPSLMASNGVAVDGCVSGTTTAEAENTSDQNLSIEESGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 5798 - protein, 176 aa, Homo sapiens
MSDDDSRASTSSSSSSSSNQQTEKETNTPKKKESKVSMSKNSKLLSTSAKSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 5799 - protein, 2342 aa, Homo sapiens
MDGVSSEANEENDNIERPVRRRHSSILKPPRSPLQDLRGGNERVQESNALRNKKNSRRVSFADTIKVFQTESHMKIVRKSEMEGCSAMVPSQLQLLPPGFKRFSCLSLPETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 5800 - protein, 545 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 5801 - protein, 110 aa, Homo sapiens
MPKRSCPFADVAPLQLKVRVSQRELSRGVCAERYSQEVFDPSGVASIACSSCVRAVDGKAVCGQCERALCGQCVRTCWGCGSVACTLCGLVDCSDMYEKVLCTSCAMFET

SEQ ID NO: 5802 - protein, 750 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 5803 - protein, 867 aa, Homo sapiens
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 5804 - protein, 619 aa, Homo sapiens
MSGLVLGQRDEPAGHRLSQEEILGSTRLVSQGLEALRSEHQAVLQSLSQTIECLQQGGHEEGLVHEKARQLRRSMENIELGLSEAQVMLALASHLSTVESEKQKLRAQVRRLCQENQWLRDELAGTQQRLQRSEQAVAQLEEEKKHLEFLGQLRQYDEDGHTSEEKEGDATKDSLDDLFPNEEEEDPSNGLSRGQGATAAQQGGYEIPARLRTLHNLVIQYAAQGRYEVAVPLCKQALEDLERTSGRGHPDVATMLNILALVYRDQNKYKEAAHLLNDALSIRESTLGPDHPAVAATLNNLAVLYGKRGKYKEAEPLCQRALEIREKVLGTNHPDVAKQLNNLALLCQNQGKYEAVERYYQRALAIYEGQLGPDNPNVARTKNNLASCYLKQGKYAEAETLYKEILTRAHVQEFGSVDDDHKPIWMHAEEREEMSKSRHHEGGTPYAEYGGWYKACKVSSPTVNTTLRNLGALYRRQGKLEAAETLEECALRSRRQGTDPISQTKVAELLGESDGRRTSQEGPGDSVKFEGGEDASVAVEWSGDGSGTLQRSGSLGKIRDVLRRSSELLVRKLQGTEPRPSSSNMKRAASLNYLNQPSAAPLQVSRGLSASTMDLSSSS

SEQ ID NO: 5805 - protein, 378 aa, Homo sapiens
MKEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 5806 - protein, 876 aa, Homo sapiens
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 5807 - protein, 496 aa, Homo sapiens; identical to SEQ ID NO: 5715

SEQ ID NO: 5808 - protein, 105 aa, Homo sapiens [sequence omitted]

SEQ ID NO: 5809 - protein, 1239 aa, Homo sapiens
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 5810 - protein, 948 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 5811 - protein, 910 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 5812 - protein, 986 aa, Homo sapiens
MSQWTPEYNELYTLKVDMKSEIPSDAPKTQESLKGILLHPEPIGAAKSFPAGVEMINSKVGNEFSHLCDDSQKQEKEMNGNQQEQEKSLVVRKKRKSQQAGPSYVQNCVKENQGILGLRQHLGTPSDEDNDSSFSDCLSSPSSSLHFGDSDTVTSDEDKEVSVRHSQTILNAKSRSHSARSHKWPRTETESVSGLLMKRPCLHGSSLRRLPCRKRFVKNNSSQRTQKQKERILMQRKKREVLARRKYALLPSSSSSSENDLSSESSSSSSTEGEEDLFVSASENHQNNPAVPSGSIDEDVVVIEASSTPQVTANEEINVTSTDSEVEIVTVGESYRSRSTLGHSRSHWSQGSSSHASRPQEPRNRSRISTVIQPLRQNAAEVVDLTVDEDEPTVVPTTSARMESQATSASINNSNPSTSEQASDTASAVTSSQPSTVSETSATLTSNSTTGTSIGDDSRRTTSSAVTETGPPAMPRLPSCCPQHSPCGGSSQNHHALGHPHTSCFQQHGHHFQHHHHHHHTPHPAVPVSPSFSDPACPVERPPQVQAPCGANSSSGTSYHEQQALPVDLSNSGIRSHGSGSFHGASAFDPCCPVSSSRAAIFGHQAAAAAPSQPLSSIDGYGSSMVAQPQPQPPPQPSLSSCRHYMPPPYASLTRPLHHQASACPHSHGNPPPQTQPPPQVDYVIPHPVHAFHSQISSHATSHPVAPPPPTHLASTAAPIPQHLPPTHQPISHHIPATAPPAQRLHPHEVMQRMEVQRRRMMQHPTRAHERPPPHPHRMHPNYGHGHHIHVPQTMSSHPRQAPERSAWELGIEAGVTAATYTPGALHPHLAHYHAPPRLHHLQLGALPLMVPDMAGYPHIRYISSGLDGTSFRGPFRGNFEELIHLEERLGNVNRGASQGTIERCTYPHKYKKRKLHCKQDGEEGTEEDTEEKCTICLSILEEGEDVRRLPCMHLFHQVCVDQWLITNKKCPICRVDIEAQLPSES

SEQ ID NO: 5813 - protein, 123 aa, Homo sapiens [sequence omitted]

SEQ ID NO: 5814 - protein, 544 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 5815 - protein, 376 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEERKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKAYRIMKRHLRLIHPTKLYKLMLRRFGM

SEQ ID NO: 5816 - protein, 1406 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIRYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPLYSRGVLSPGRHVRTRLYFTSESHVHSLLSVFRYGGLLDETQDAQWQRALDYLSAISELNYMTQIVIMLYEDNTQDPLSEERFHVELHFSPGVKGVEEEGSAPAGCGFRPASSENEEMKTNQGSMENLCPGKASDEPDRALQTSPQPPEGPGLPRRSPLIRNRKAGSMEVLSETSSSRPGGYRLFSSSRPPTEMKQSGLGFEGCSMVPTIYPLETLHNALSLRQVSEFLSRVCQRHTDAQAQASAALFDSMHSSQASDNPFSPPRTLHSPPLQLQQRSEKPPWLETRFCHVGQAGLELLTSSDLPASASQSAGITGVSHRTQPDSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 5817 - protein, 445 aa, Homo sapiens
MVLEGNPEVGSPRTSDLQHRGNKGSCVLSSPGEDAQPGEEPIKYGELIVLGYNGCLASGDKGRRRSRLALSRRSHANGVKPDVMHHISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGCVRLIFQGPLD

SEQ ID NO: 5818 - protein, 649 aa, Homo sapiens
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 5819 - protein, 264 aa, Homo sapiens
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 5820 - protein, 241 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEIGFEAPPLQGQAAAPASGSGADSEPARHIFSFSWLNSLNE

SEQ ID NO: 5821 - protein, 1166 aa, Homo sapiens [sequence omitted]

SEQ ID NO: 5822 - protein, 821 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVTWKTGQVERGRAWKPPASLALCSRSCDSMVSCYASILCKALWKEKLHTFWHHNRISFLPSAFRPIPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 5823 - protein, 322 aa, Homo sapiens
MVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 5824 - protein, 448 aa, Homo sapiens
MSSRKLSGPKGRRLSIHVVTWNVASAAPPLDLSDLLQLNNRNLNLDIYVIGLQELNSGIISLLSDAAFNDSWSSFLMDVLSPLSFIKVSHVRMQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 5825 - protein, 546 aa, Homo sapiens; identical to SEQ ID NO: 5763

SEQ ID NO: 5826 - protein, 1279 aa, Homo sapiens
MLQALQLRTGFFCFRVLVALSPCALHDSGRLTTGSFNVVRDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAVRIDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQSTVDQKRASHHESNGFAGRIHLLPDLLQQSHSSSTSSTSSSPSSSQPTPTMSPQTPQDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 5827 - protein, 662 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 5828 - protein, 800 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 5829 - protein, 186 aa, Homo sapiens
MAGENFATPFHGHVGRGAFSDVYEPAEDTFLLLNALEAAAAELAGVEICLEVGSGSGVVSAFLASMIGPQALYMCTDINPEAAACTLETARCNKVHIQPVITDLVGSHGIEAAWAGGKNGREVMDRFFPLVPDLLSPKGLFYLVTIKENNPEEILKIMKTKGLQGTTALSRQAGQETLSVLKFTKS

SEQ ID NO: 5830 - protein, 783 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGFPAPPKQLDMGDEVYDDVDTSDFPVSSAEMSQGTNVGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 5831 - protein, 573 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 5832 - protein, 824 aa, Homo sapiens
MMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIDASYVDPLGPQIERPKTAAKKRIDEDDFADEELGDDLLPE

SEQ ID NO: 5833 - protein, 949 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLQLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 5834 - protein, 1931 aa, Homo sapiens
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVVLSCSLLTTAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 5835 - protein, 142 aa, Homo sapiens
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAKNGENTANGEENGAHTIA

SEQ ID NO: 5836 - protein, 567 aa, Homo sapiens
MEFFTMPPRTWFMRQLQRMWFLRPSMAIMVFRMIEERPTHAITVRVSYLEIYNESLFDLLSTLPYVGPSVTPMTIVENPQGVFIKGLSVHLTSQEEDAFSLLFEGETNRIIASHTMNKNSSRSHCIFTIYLEAHSRTLSEEKYITSKINLVDLAGSERLGKSGSEGQVLKEATYINKSLSFLEQAIIALGDQKRDHIPFRQCKLTHALKDSLGGNCNMVLVTNIYGEAAQLEETLSSLRFASRMKLVTTEPAINEKYDAERMVKNLEKELALLKQELAIHDSLTNRTFVTYDPMDEIQIAEINSQVRRYLEGTLDEIDIISLRQIKEVFNQFRVVLSQQEQEVESTLRRKYTLIDRNDFAAISAIQKAGLVDVDGHLVGEPEGQNFGLGVAPFSTKPGKKAKSKKTFKEPLRPDTPPSKPVAFEEFKNEQGSEINRIFKENKSILNERRKRASETTQHINAIKREIDVTKEALNFQKSLREKQGKYENKGLMIIDEEEFLLILKLKDLKKQYRSEYQDLRDLRAEIQYCQHLVDQCRHRLLMGATVGKNLTSGTMSPLSSLRTCRWH

SEQ ID NO: 5837 - protein, 475 aa, Homo sapiens
MAEGSVMFSDVSIDFSQEEWDCLDPVQRDLYRDVMLENYGNLVSMGLYTPKPQVISLLEQGKEPWMVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYECKECGKAFSYCSNLIDHQRIHTGEKPYECKVCGKAFTKSSQLFQHARIHTGEKPYECKECGKAFTQSSKLVQHQRIHTGEKPYECKECGKAFSSGSALTNHQRIHTGEKPYDCKECGKAFTQSSQLRQHQRIHAGEKPFECLECGKAFTQNSQLFQHQRIHTDEKPYECNECGKAFNKCSNLTRHLRIHTGEKPYNCKECGKAFSSGSDLIRHQGIHTNK

SEQ ID NO: 5838 - protein, 153 aa, Homo sapiens; identical to SEQ ID NO: 4872

SEQ ID NO: 5839 - protein, 871 aa, Homo sapiens
MGEGGLPPAFQLLLRACDQGDTETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAARFGHVSVAHLLLDHGADVNAQNRLGASVLTVASRGGHLGVVKLLLEAGAFVDHHHPSGEQLGLGGSRDEPLDITALMAAIQHGHEAVVRLLMEWGADPNHAARTVGWSPLMLAALTGRLGVAQQLVEKGANPDHLSVLEKTAFEVALDCKHRDLVDYLDPLTTVRPKTDEEKRRPDIFHALKMGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 5840 - protein, 452 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQIGFEAPPLQGQAAAPASGSGADSEPARHIFSFSWLNSLNE

SEQ ID NO: 5841 - protein, 163 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 5842 - protein, 399 aa, Homo sapiens
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 5843 - protein, 373 aa, Homo sapiens
MAQESPKNSAAEIPVTSNGEVDDSREHSFNRDLKHSLPSGLGLSETQITSHGFDNTKEGVIEAGAFQGSPAPPLPSVMSPSRVAASRLAQQGSDLIVPAGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 5844 - protein, 217 aa, Homo sapiens
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKVTHILNVAYGVENAFLSDFTYKSISILDLPETNILSYFPECFEFIEEAKRKDGVVLVHCNAGVSRAAAIVIGFLMNSEQTSFTSAFSLVKNARPSICPNSGFMEQLRTYQEGKESNKCDRIQENSS

SEQ ID NO: 5845 - protein, 892 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLCWMLFGMDLNKMTHSRLAALRVTKPYLDIGC

SEQ ID NO: 5846 - protein, 314 aa, Homo sapiens
MQTFLKGKRVGYWLSEKKIKKLNFQAFAELCRKRGMEVVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGDCQVCFIEGWKTD

SEQ ID NO: 5847 - protein, 209 aa, Homo sapiens
MPVAVMAESAFSFKKLLDQCENQELEAPGGIATPPVYGQLLALYLLHNDMNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 5848 - protein, 1644 aa, Homo sapiens
MFWCGTCFVTNNMKGSEVSLEKKKKIKMPVKRLREVVSQNHGDHLVLLKDELPCVPPALSANKRLPVGTGTSLNGTSRGSSDLTSARNCYQPLLENPMVSESDFSKDVAVQVLPLDKIEENNKQKANDIFISQYTMGQKDALRTVLKQNVSLCLTGWSDHSGVITTHCSLYLLRLMRSSHLSLPSSWDYRAQSMPVFKEVKVHLLEDAGIEKDAVTQETRISPSGIDSATTVAAATAAAIATAAPLIKVQSDLEAKVNSVTELLSKLQETDKHLQRVTEQQTSIQRKQEKLHCHDHEKQMNVFMEQHIRHLEKLQQQQIDIQTHFISAALKTSSFQPVSMPSSRAVEKYSVKPEHPNLGSCNPSLYNTFASKQAPLKEVEDTSFDKQKSPLETPAPRRFAPVPVSRDDELSKRENLLEEKENMEVSCHRGNVRLLEQILNNNDSLTRKSESSNTTSLTRSKIGWTPEKTNRFPSCEELETTKVTMQKSDDVLHDLGQKEKETNSMVQPKESLSMLKLPDLPQNSVKLQTTNTTRSVLKDAEKILRGVQNNKKVLEENLEAIIRAKDGAAMYSLINALSTNREMSEKIRIRKTVDEWIKTISAEIQDELSRTDYEQKRFDQKNQRTKKGQNMTKDIRTNTQDKTVNKSVIPRKHSQKQIEEHFRNLPMRGMPASSLQKERKEGLLKATTVIQDEDYMLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMPPAGVIVSKPHPVTVTTSIPPSSRKVETGVKKPNIAIVEMKSEKKDPPQLTVQVLPSVDIDSISNSSADVLSPLSSPKEASLPPVQTWIKTPEIMKVDEEEVKFPGTNFDEIIDVIQEEEKCDEIPDSEPILEFNRSVKADSTKYNGPPFPPVASTFQPTADILDKVIERKETLENSLIQWVEQEIMSRIISGLFPVQQQIAPSISVSVSETSEPLTSDIVEGTSSGALQLFVDAGVPVNSNVIKHFVNEALAETIAVMLGDREAKKQGPVATGVSGDASTNETYLPARVCTPLPTPQPTPPCSPSSPAKECVLVKTPDSSPCDSDHDMAFPVKEICAEKGDDMPAIMLVNTPTVTPTTTPPPAAAVFTPTLSDISIDKLKVSSPELPKPWGDGDLPLEEENPNSPQEELHPRAIVMSVAKDEEPESMDFPAQPPPPEPVPFMPFPAGTKAPSPSQMPGSDSSTLESTLSVTVTETETLDKPISEGEILFSCGQKLAPKILEDIGLYLTNLNDSLSSTLHDAVEMEDDPPSEGQVIRMSHKKFHADAILSFAKQNQESAVSQQAVYHSEDLENSVGELSEGQRPQLTAAAENILMGHSLYMQPPVTNTQSLDQQCDPKPLSRQFDTVSGSIYEDSCASHGPMSLGELELEPNSKLVLPTTLLTAQENDVNLPVAAEDFSQYQLKQNQDVKQVEHKPSQSYLRVRNKSDIAPSQQQVSPGDMDRTQIELNPYLTCVFSGLGVHVKKVSCIGKLGLWRFVIQIISSPRWESSATLRFTDAPCQDVSDAAVSEPRGLLSVSESQHNAGGHGVFGGRYLLNGKRQPAQCLCHWF

SEQ ID NO: 5849 - protein, 1045 aa, Homo sapiens
MLTVQVKTSSAIELPDSLAFLWIIPMWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 5850 - protein, 316 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 5851 - protein, 490 aa, Homo sapiens; identical to SEQ ID NO: 5369

SEQ ID NO: 5852 - protein, 475 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHERWGFTMLSSLVLNFGIQAIRQPQRPKVLELQV

SEQ ID NO: 5853 - protein, 779 aa, Homo sapiens
MRIEERKSQHLTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 5854 - protein, 703 aa, Homo sapiens
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 5855 - protein, 1081 aa, Homo sapiens
MESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 5856 - protein, 2407 aa, Homo sapiens
MVGERHAGDLMVPLGPRLQAYPEELIRQRPGHDGHPEYLIRWSVLKCGEVGKVGVEEGKAEHILMWLSAPEVYANCPGLLGERALSKGLQHEPAGVSGSFPRDPGGLDEVAMGEMEADVQALVRRAARQLAESGTPSLTAAVLHTIHVLSAYASIGPLTGVFRETGALDLLMHMLCNPEPQIRRSAGKMLQALAAHDAGSRAHVLLSLSQQDGIEQHMDFDSRYTLLELFAETTSSEEHCMAFEGIHLPQIPGKLLFSLVKRYLCVTSLLDQLNSSPELGAGDQSSPCATREKSRGQRELEFSMAVGNLISELVRSMGWARNLSEQGMSPPRPTRSIFQPYISGPSLLLPTIVTTPRRQGWVFRQRSEFSSRSGYGEYVQQTLQPGMRVRMLDDYEEISAGDEGEFRQSNNGIPPVQTLGEKALGEISVSVEMAESLLQVLSSRFEGSTLNDLLNSQIYTKYGLLSNEPSSSSTSRNHSCTPDPEEESKSEASFSEEETESLKAKAEAPKTEAEPTKTRTETPMAQSDSQLFNQLLVTEGMTLPTEMKEAASEMARALRGPGPRSSLDQHVAAVVATVQISSLDTNLQLSGLSALSQAVEEVTERDHPLVRPDRSLREKLVKMLVELLTNQVGEKMVVVQALRLLYLLMTKHEWRPLFAREGGIYAVLVCMQEYKTSVLVQQAGLAALKMLAVASSSEIPTFVTGRDSIHSLFDAQMTREIFASIDSATRPGSESLLLTVPAAVILMLNTEGCSSAARNGLLLLNLLLCNHHTLGDQIITQELRDTLFRHSGIAPRTEPMPTTRTILMMLLNRYSEPPGSPERAALETPIIQGQDGSPELLIRSLVGGPSAELLLDLERVLCREGSPGGAVRPLLKRLQQETQPFLLLLRTLDAPGPNKTLLLSVLRVITRLLDFPEAMVLPWHEVLEPCLNCLSGPSSDSEIVQELTCFLHRLASMHKDYAVVLCCLGAKEILSKVLDKHSAQLLLGCELRDLVTECEKYAQLYSNLTSSILAGCIQMVLGQIEDHRRTHQPINIPFFDVFLRHLCQGSSVEVKEDKCWEKVEVSSNPHRASKLTDHNPKTYWESNGSTGSHYITLHMHRGVLVRQLTLLVASEDSSYMPARVVVFGGDSTSCIGTELNTVNVMPSASRVILLENLNRFWPIIQIRIKRCQQGGIDTRVRGVEVLGPKPTFWPLFREQLCRRTCLFYTIRAQAWSRDIAEDHRRLLQLCPRLNRVLRHEQNFADRFLPDDEAAQALGKTCWEALVSPLVQNITSPDAEGVSALGWLLDQYLEQRETSRNPLSRAASFASRVRRLCHLLVHVEPPPGPSPEPSTRPFSKNSKGRDRSPAPSPVLPSSSLRNITQCWLSVVQEQVSRFLAAAWRAPDFVPRYCKLYEHLQRAGSELFGPRAAFMLALRSGFSGALLQQSFLTAAHMSEQFARYIDQQIQGGLIGGAPGVEMLGQLQRHLEPIMVLSGLELATTFEHFYQHYMADRLLSFGSSWLEGAVLEQIGLCFPNRLPQLMLQSLSTSEELQRQFHLFQLQRLDKLFLEQEDEEEKRLEEEEEEEEEEEAEKELFIEDPSPAISILVLSPRCWPVSPLCYLYHPRKCLPTEFCDALDRFSSFYSQSQNHPVLDMGPHRRLQWTWLGRAELQFGKQILHVSTVQMWLLLKFNQTEEVSVETLLKDSDLSPELLLQALVPLTSGNGPLTLHEGQDFPHGGVLRLHEPGPQRSGEALWLIPPQAYLNVEKDEGRTLEQKRNLLSCLLVRILKAHGEKGLHIDQLVCLVLEAWQKGPNPPGTLGHTVAGGVACTSTDVLSCILHLLGQGYVKRRDDRPQILMYAAPEPMGPCRGQADVPFCGSQSETSKPSPEAVATLASLQLPAGRTMSPQEVEGLMKQTVRQVQETLNLEPDVAQHLLAHSHWGAEQLLQSYSEDPEPLLLAAGLCVHQAQAVPVRPDHCPVCVSPLGCDDDLPSLCCMHYCCKSCWNEYLTTRIEQNLVLNCTCPIADCPAQPTGAFIRAIVSSPEVISKYEKALLRGYVESCSNLTWCTNPQGCDRILCRQGLGCGTTCSKCGWASCFNCSFPEAHYPASCGHMSQWVDDGGYYDGMSVEAQSKHLAKLISKRCPSCQAPIEKNEGCLHMTCAKCNHGFCWRCLKSWKPNHKDYYNCSAMVSKAARQEKRFQDYNERCTFHHQAREFAVNLRNRVSAIHEVPPPRSFTFLNDACQGLEQARKVLAYACVYSFYSQDAEYMDVVEQQTENLELHTNALQILLEETLLRCRDLASSLRLLRADCLSTGMELLRRIQERLLAILQHSAQDFRVGLQSPSVEAWEAKGPNMPGSQPQASSGPEAEEEEEDDEDDVPEWQQDEFDEELDNDSFSYDESENLDQETFFFGDEEEDEDEAYD

SEQ ID NO: 5857 - protein, 223 aa, Homo sapiens
MEDVKLEFPSLPQCKEDAEEWTYPMRREMQEILPGLFLGPYSSAMKSKLPVLQKHGITHIICIRQNIEANFIKPNFQQLFRYLVLDIADNPVENIIRFFPMTKEFIDGSLQMGGKVLVHGNAGISRSAAFVIAYIMETFGMKYRDAFAYVQERRFCINPNAGFVHQLQEYEAIYLAKLTIQMMSPLQIERSLSVHSGTTGSLKRTHEEEDDFGTMQVATAQNG

SEQ ID NO: 5858 - protein, 562 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKCMYHLGVGLLDPSRSFWIAIPWACPGLGVAALC

SEQ ID NO: 5859 - protein, 119 aa, Homo sapiens
MILQQPLQRGPQGGAQRLPRAALGVTWGLDAREPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 5860 - protein, 597 aa, Homo sapiens
MVPEERRVGLSSDETSSDSLKSWHSICVLDSKEQPLACQQKQRQFVKPVTESEQPTVLELLLAELRTLFSAVLQDSSPAAWRYLHAVLGLLPPYRELLVGHLDLLPFLEQLYCWAPWVQTHLHLDLLGAIVQAFPPDSSLLDSASHADCCPQKRRLHHRPPCPACPFVQAQWSRQQVKEELATWLRPLTLPELQRCLGIVGAQVALEEAVWLDGLSLLPLALAADIPVRYESSDTDNAEVEPVGRKETRSQLDYEVPREKAFQKSSTGFSPETSFLDSQVMTALKMERYLKKIHFLYLNVAPSRYFRPYSLMVVPPDKVNPEHYIFSPFGILHVHPVEGSETMTLGTWHHHCVLWQQLQFIPFFKYCLLRKSFTCWKKNVRLQGLHRLQKFLENHLLLAVPHFGAGLLHISRLLQELHSVSWLPQELDRCYELLDLQTALAEEKHKALRLLHRCLNLCTSILRLVHEDTYHMQQCLQERVQNCDRIRTGQGSIYLQRVQHKQLEQKLKQAEAWWLQLGKFARLVDYMICQSLISVLEEQITSFVANILQAPRQKPFLSSQLVFDDHGQLSHVPCVENMIQTLTGGLQSVKTSALQVF

SEQ ID NO: 5861 - protein, 196 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTVC

SEQ ID NO: 5862 - protein, 295 aa, Homo sapiens; identical to SEQ ID NO: 5678

SEQ ID NO: 5863 - protein, 304 aa, Homo sapiens
MKRAHPEYSSSDSELDETIEVEKESADENGNLSSALGSMSPTTSSQILARKRRRGIIEKRRRDRINNSLSELRRLVPSAFEKQGSAKLEKAEILQMTVDHLKMLHTAGGKGYFDAHALAMDYRSLGFRECLAEVARYLSIIEGLDASDPLRVRLVSHLNNYASQREAASGAHAGLGHIPWGTVFGHHPHIAHPLLLPQNGHGNAGTTASPTEPHHQGRLGSAHPEAPALRAPPSGSLGPVLPVVTSASKLSPPLLSSVASLSAFPFSFGSFHLLSPNALSPSAPTQAANLGKPYRPWGTEIGAF

SEQ ID NO: 5864 - protein, 842 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWAIQGSLTRRERRASGVRTRRSQGSSAMASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 5865 - protein, 498 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAAPRSKRLLLPKDNNGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 5866 - protein, 859 aa, Homo sapiens
MLEVLEEIWSVRARRAHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGSHLGPPGACPLPSLGLDCWGVGLKGGVSAPGTQAGVASTTRPCLGTGPSLASPH

SEQ ID NO: 5867 - protein, 421 aa, Homo sapiens
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 5868 - protein, 676 aa, Homo sapiens
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQVLDQYEREGFNFLAKVFNSSHSFLEDLTGLTLLHQETQAAEIWDMSDDETI

SEQ ID NO: 5869 - protein, 442 aa, Homo sapiens
MASDGASALPGPDMSMKPSAAPSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLPTNGESQC

SEQ ID NO: 5870 - protein, 221 aa, Homo sapiens
MQVQDDGVNLIPFAKCSRVVSRSPPPRLPSQSLRPMPQRYGDVFWKNLNQRPTPTWLEEQHIPPMLLPPPEMLWRRKKRRPCLEGMQQQGLGGVPARVRAVTYHLEDLRRRQSIINELKKAQWGSSGAASEPVVLGEEGCGFPSTNEYPDLEEERATYPQEEDRFLTPGRAQLLWSPWSPLDQEEACASRQLHSLASFSTVTARRNPLHNPWGMELAASEE

SEQ ID NO: 5871 - protein, 159 aa, Homo sapiens
MQRVGNTFSNESRVASRCPSVGLAERNRVATMPVRLLRDSPAAQEDNDHARDGFQMKLDAHGFAPEELVVQVDGQWLMVTGQQQLDVRDPERVSYRMSQKVHRKMLPSNLSPTAMTCCLTPSGQLWVRGQCVALALPEAQTGPSPRLGSLGSKASNLTR

SEQ ID NO: 5872 - protein, 593 aa, Homo sapiens
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 5873 - protein, 869 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQGTNLPPSRQIVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 5874 - protein, 631 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 5875 - protein, 566 aa, Homo sapiens
MDLHRAAFKMENSSYLPNPLASPALMVLASTAEASRDASIPCQQPRPFGVPVSVDKDVHIPFTNGSYTFASMYHRQGGVPGTFANRDFPPSLLHLHPQFAPPNLDCTPISMLNHSGVGAFRPFASTEDRESYQSAFTPAKRLKNCHDTESPHLRFSDADGKEYDFGTQLPSSSPGSLKVDDTGKKIFAVSGLISDREASSSPEDRNDRCKKKAAALFDSQAPICPICQVLLRPSELQEHMEQELEQLAQLPSSKNSLLKDAMAPGTPKSLLLSASIKREGESPTASPHSSATDDLHHSDRYQTFLRVRANRQTRLNARIGKMKRRKQDEGQREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 5876 - protein, 356 aa, Homo sapiens
MLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 5877 - protein, 172 aa, Homo sapiens
MSYNCCSGNFSSRSCGGYLHYPASSCGFSYPSNQVYSTDLCSPSTCQLGSSLYRGCQQTCWEPTSCQTSYVESSPCQTSCYRPRTSLLCSPCQTTYSGSLGFGSSSCRSLGYGSRSCYSVGCGSSGFRSLGYGGCGFPSLGYGVGFCRPTYLASRSCQSSCYRPTCGSGFYY

SEQ ID NO: 5878 - protein, 750 aa, Homo sapiens; identical to SEQ ID NO: 5802

SEQ ID NO: 5879 - protein, 295 aa, Homo sapiens; identical to SEQ ID NO: 5678

SEQ ID NO: 5880 - protein, 491 aa, Homo sapiens
MDTKGCTTTNSPSTPCQNCSRITNVSTISSNNGCHPGGLTVNNCQPAGHVLRIPWDQGCQPTPRFCRKPIYLMNNFNARFSLDDCSWYGEGINSNEKETMQILNERLANYLQKVRMLERENAELESKIQEESNKELPVLCPDYLSYYTTIEELQQKILCTKAENSRLVSQIDNTKLTADDLRAKYEAEVSLRQLVESDANGLKQILNVLTLGKADLEAQVQSLKEELLCLKNNHKEEINSLQCQLGERLDIEVTAAPSADLNQVLQEMRCQYEPIMETNRKDVEQWFNTQIEELNQQVVTSSQQQQCCQKEIIELRRSVNTLEVELQAQHRMRDSQECILTETEARYTALLTQIQSLIDNLEAQLAEIRCALERQNQEYEILLDVKSRLECEITTYRSLLESSDGKRPCYPRATKCEPSPWTSCKSGAIESTAPACTSSSPCSLKEHCSACGPLSRILVKICTITKEIKDGKVISSYEHVQPCFIIRPAKV

SEQ ID NO: 5881 - protein, 428 aa, Homo sapiens
MKRGGRDSDRNSSEEGTAEKSKKLRTTNEHSQTCDWGNLLQDIILQVFKYLPLLDRAHASQVCRNWNQVFHMPDLWRCFEFELNQPATSYLKATHPELIKQIIKRHSNHLQYVSFKVDSSKESAEAACDILSQLVNCSLKTLGLISTARPSFMDLPKSHFISALTVVFVNSKSLSSLKIDDTPVDDPSLKVLVANNSDTLKLLKMSSCPHVSPAGILCVADQCHGLRELALNYHLLSDELLLALSSEKHVRLEHLRIDVVSENPGQTHFHTIQKSSWDAFIRHSPKVNLVMYFFLYEEEFDPFFRYEIPATHLYFGRSVSKDVLGRVGMTCPRLVELVVCANGLRPLDEELIRIAERCKNLSAIGLGECEVSCSAFVEFVKMCGGRLSQLSIMEEVLIPDQKYSLEQIHWEVSKHLGRVWFPDMMPTW

SEQ ID NO: 5882 - protein, 1200 aa, Homo sapiens
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 5883 - protein, 489 aa, Homo sapiens
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLLSKNLSREINDCIGGTVLNISKSGSCSAIRIGHVGMQIEHIIENIVAVTKGLSEKLPEWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKKPKIKEEAVKEKSPSLGKKDARQTPKKPEAKFFTTPSKSVRKASHTPKKWPKKPKVPQST

SEQ ID NO: 5884 - protein, 1056 aa, Homo sapiens
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 5885 - protein, 285 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQGSTNYGKSQRRGGHQNNYKPY

SEQ ID NO: 5886 - protein, 403 aa, Homo sapiens; identical to SEQ ID NO: 5446

SEQ ID NO: 5887 - protein, 448 aa, Homo sapiens
MATDSWALAVDEQEAAAESLSNLHLKEEKIKPDTNGAVVKTNANAEKTDEEEKEDRAAQSLLNKLIRSNLVDNTNQVEVLQRDPNSPLYSVKSFEELRLPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 5888 - protein, 415 aa, Homo sapiens; identical to SEQ ID NO: 5668

SEQ ID NO: 5889 - protein, 341 aa, Homo sapiens
MAQESPKNSAAEIPVTSNGEVDDSREHSFNRDLKHSLPSGLGLSETQITSHGFDNTKEGVIEAGAFQGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 5890 - protein, 523 aa, Homo sapiens
MANVGLQFQASAGDSDPQSRPLLLLGQLHHLHRVPWSHVRGKLQPRVTEELWQAALSTLNPNPTDSCPLYLNYATVAALPCRVSRHNSPSAAHFITRLVRTCLPPGAHRCIVMVCEQPEVFASACALARAFPLFTHRSGASRRLEKKTVTVEFFLVGQDNGPVEVSTLQCLANATDGVRLAARIVDTPCNEMNTDTFLEEINKVGKELGIIPTIIRDEELKTRGFGGIYGVGKAALHPPALAVLSHTPDGATQTIAWVGKGIVYDTGGLSIKGKTTMPGMKRDCGGAAAVLGAFRAAIKQGFKDNLHAVFCLAENSVGPNATRPDDIHLLYSGKTVEINNTDAEGRLVLADGVSYACKDLGADIILDMATLTGAQGIATGKYHAAVLTNSAEWEAACVKAGRKCGDLVHPLVYCPELHFSEFTSAVADMKNSVADRDNSPSSCAGLFIASHIGFDWPGVWVHLDIAAPVHAGERATGFGVALLLALFGRASEDPLLNLVSPLGCEVDVEEGDLGRDSKRRRLV

SEQ ID NO: 5891 - protein, 456 aa, Homo sapiens
MADGGSERADGRIVKMEVDYSATVDQRLPECAKLAKEGRLQEVIETLLSLEKQTRTASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 5892 - protein, 336 aa, Homo sapiens
MKIDIHSHILPKEWPDLKKRFGYGGWVQLQHHSKGEAKLLKDGKVFRVVRENCWDPEVRIREMDQKGVTVQALSTVPVMFSYWAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 5893 - protein, 538 aa, Homo sapiens
MELSYQTLKFTHQAREACEMRTEARRKNLLILISHYLTQEGYIDTANALEQETKLGLRRFEVCDNIDLETILMEYESYYFVKFQKYPKIVKKSSDTAENNLPQRSRGKTRRMMNDSCQNLPKINQQRPRSKTTAGKTGDTKSLNKEHPNQEVVDNTRLESANFGLHISRIRKDSGEENAHPRRGQIIDFQGLLTDAIKGATSELALNTFDHNPDPSERLLKPLSAFIGMNSEMRELAAVVSRDIYLHNPNIKWNDIIGLDAAKQLVKEAVVYPIRYPQLFTGILSPWKGLLLYGPPGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAASNLPWELDCAMLRRLEKRILVDLPSREARQAMIYHWLPPVSKSRALELHTELEYSVLSQETEGYSGSDIKLVCREAAMRPVRKIFDALENHQSESSDLPRIQLDIVTTADFLDVLTHTKPSAKNLAQRYSDWQREFESV

SEQ ID NO: 5894 - protein, 168 aa, Homo sapiens; identical to SEQ ID NO: 5318

SEQ ID NO: 5895 - protein, 587 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 5896 - protein, 842 aa, Homo sapiens
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLALTYSLRDRERGGGRAQIGVVDDEAKAPDLMQIMEAVLGRRVGSLRAATPSKDINQLQKANVRLYHVYEKGKDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRAPYPSNKRLPEEVPSFQPRLFECSSHMGCLVLAEVGFFSQEDLDKYDIMLLDTWQEIFLWLGEAASEWKEAVAWGQEYLKTHPAGRSPATPIVLVKQGHEPPTFIGWFFTWDPYKWTSHPSHKEVVDGSPAAASTISEITAEVNNLRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 5897 - protein, 539 aa, Homo sapiens
MDAMASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSPCLNVLSRLLFSSDPDVLADVCWALSYLSDGPNDKIQAVIDSGVCRRLVELLMHNDYKVVSPALRAVGNIVTGDDIQTQVILNCSALPCLLHLLSSPKESIRKEACWTVSNITAGNRAQIQAVIDANIFPVLIEILQKAEFRTRKEAAWAITNATSGGTPEQIRYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 5898 - protein, 1244 aa, Homo sapiens
MLIKEYHILLPMSLDEYQVAQLYMIQKKSREESSGEGSGVEILANRPYTDGPGGSGQYTHKVYHVGSHIPGWFRALLPKAALQVEEESWNAYPYTRTRYTCPFVEKFSIEIETYYLPDGGQQPNVFNLSGAERRQRILDTIDIVRDAVAPGEYKAEEDPRLYHSVKTGRGPLSDDWARTAAQTGPLMCAYKLCKVEFRYWGMQAKIEQFIHDVGLRRVMLRAHRQAWCWQDEWTELSMADIRALEEETARMLAQRMAKCNTGSEGSEAQPPGKPSTEARSAASNTGTPDGPEAPPGPDASPDASFGKQWSSSSRSSYSSQHGGAVSPQSLSEWRMQNIARDSENSSEEEFFDAHEGFSDSEEVFPKEMTKWNSNDFIDAFASPVEAEGTPEPGAEAAKGIEDGAQAPRDSEGLDGAGELGAEACAVHALFLILHSGNILDSGPGDANSKQADVQTLSSAFEAVTRIHFPEALGHVALRLVPCPPICAAAYALVSNLSPYSHDGDSLSRSQDHIPLAALPLLATSSSRYQGAVATVIARTNQAYSAFLRSPEGAGFCGQVALIGDGVGGILGFDALCHSANAGTGSRGSSRRGSMNNELLSPEFGPVRDPLADGVEGLGRGSPEPSALPPQRIPSDMASPEPEGSQNSLQAAPATTSSWEPRRASTAFCPPAASSEAPDGPSSTARLDFKVSGFFLFGSPLGLVLALRKTVMPALEAAQMRPACEQIYNLFHAADPCASRLEPLLAPKFQAIAPLTVPRYQKFPLGDGSSLLLADTLQTHSSLFLEELEMLVPSTPTSTSGAFWKGSELATDPPAQPAAPSTTSEVVKILERWWGTKRIDYSLYCPEALTAFPTVTLPHLFHASYWESADVVAFILRQVIEKERPQLAECEEPSIYSPAFPREKWQRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKAMFLQSLVQEVELNIVAGYGSPKDVAVYAALGLSPSQTYIVGRAVRKLQAQCQFLSDGYVAHLGQLEAGSHSHASSGPPRAALGKSSYGVAAPVDFLRKQSQLLRSRGPSQAEREGPGTPPTTLARGKARSISLKLDSEE

SEQ ID NO: 5899 - protein, 293 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 5900 - protein, 82 aa, Homo sapiens
MSEGESQTVLSSGSDPKVESSSSAPGLTSVSPPVTSTTSAASPEEEEESEDESEILEESPCGRWQKRREEVNQRNVPGIDSA

SEQ ID NO: 5901 - protein, 1685 aa, Homo sapiens
MSLPFYQRCHQHYDLSYRNKDVRSTVSHYQREKKRSAVYTQGSTAYSSRSSAAHRRESEAFRRASASSSQQQASQHALSSEVSRKAASAYDYGSSHGLTDSSLLLDDYSSKLSPKPKRAKHSLLSGEEKENLPSDYMVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLRKTLEETETYHAKLNEDHLLHAPEFIIKPRSHTVWEKENVKLHCSIAGWPEPRVTWYKNQVPINVHANPGKYIIESRYGMHTLEINGCDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIQWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEPVAALDPAEKARLKSRPSAPWTGQIIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEASVAGSGKWEPCNNNPVKGSRFTCHGLVTGQSYIFRVRAVNAAGLSEYSQDSEAIEVKAAIGGGVSPDVCPALSDEPGGLTASRGRVHEASPPTFQKDALLGSKPNKPSLPSSSQNLGQTEVSKVSETVQEELTPPPQKAAPQGKSKSDPLKKKTDRAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 5902 - protein, 1958 aa, Homo sapiens
MADRTAPRCQLRLEWVYGYRGHQCRNNLYYTAGKEVVYFVAGVGVVYNTREHSQKFFLGHNDDIISLALHPDKTLVATGQVGKEPYICIWDSYNVQTVSLLKDVHTHGVACLAFDSDGQRLASVGLDAKNTVCIWDWRKGKLLASATGHSDRIFDISWDPYQPNRVVSCGVKHIKFWTLCGNALTAKRGIFGKTGDLQTILCLACAKEDITYSGALNGDIYVWKGLNLVRTIQGAHSAGIFSMYACEEGFATGGRDGCIRLWDTDFKPITKIDLRETEQGYKGLSIRSVCWKADRLLAGTQDSEIFEVIVRERDKPMLILQGHCEGELWALALHPKKPLAVTGSDDRSVRLWSLADHALIARCNMEEAVRSVAFSPDGSQLALGMKDGSFIVLRVRDMTEVVHIKDRKEVIHEMKFSPDGSYLAVGSNDGPVDVYAVAQRYKKIGECSKSLSFITHIDWSLDSKYLQTNDGAGERLFYRMPSGKPLTSKEEIKGIPWASWTCVKGPEVSGIWPKYTEVTDINSVDANYNSSVLVSGDDFGLVKLFKFPCLKRGAKFRKYVGHSAHVTNVRWSHDFQWVLSTGGADHSVFQWRFIPEGVSNGMLETAPQEGGADSYSEESDSDLSDVPELDSDIEQEAQINYDRQVYKEDLPQLKQQSKEKNHAVPFLKREKAPEDSLKLQFIHGYRGYDCRNNLFYTQAGEVVYHIAAVAVVYNRQQHSQRLYLGHDDDILSLTIHPVKDYVATGQVGRDAAIHVWDTQTLKCLSLLKGQHQRGVCALDFSADGKCLVSVGLDDFHSIVFWDWKKGEKIATTRGHKDKIFVVKCNPHHVDKLVTVGIKHIKFWQQAGGGFTSKRGTFGSVGKLETMMCVSYGRMEDLVFSGAATGDIFIWKDILLLKTVKAHDGPVFAMYALDKGFVTGGKDGIVELWDDMFERCLKTYAIKRSALSTSSKGLLLEDNPSIRAITLGHGHILVGTKNGEILEIDKSGPMTLLVQGHMEGEVWGLAAHPLLPICATVSDDKTLRIWELSAQHRMLAVRKLKKGGRCCAFSPDGKALAVGLNDGSFLVVNADTVEDMVSFHHRKEMISDIKFSKDTGKYLAVASHDNFVDIYNVLTSKRVGICKGASSYITHIDWDSRGKLLQVNSGAREQLFFEAPRGKRHIIRPSEIEKIEWDTWTCVLGPTCEGIWPAHSDITDVNAASLTKDCSLLATGDDFGFVKLFSYPVKGQHARFKKYVGHSAHVTNVRWLHNDSVLLTVGGADTALMIWTREFVGTQESKLVDSEESDTDVEEDGGYDSDVAREKAIDYTTKIYAVSIREMEGTKPHQQLKEVSVEERPPVSRAAPQPEKLQKNNITKKKKLVEELALDHVFGYRGFDCRNNLHYLNDGADIIFHTAAAGIVQNLSTGSQSFYLEHTDDILCLTVNQHPKYRNVVATSQIGTTPSIHIWDAMTKHTLSMLRCFHSKGVNYINFSATGKLLVSVGVDPEHTITVWRWQEGAKVASRGGHLERIFVVEFRPDSDTQFVSVGVKHMKFWTLAGSALLYKKGVIGSLGAAKMQTMLSVAFGANNLTFTGAINGDVYVWKDHFLIRLVAKAHTGPVFTMYTTLRDGLIVTGGKERPTKEGGAVKLWDQEMKRCRAFQLETGQLVECVRSVCRGKGKILVGTKDGEIIEVGEKNAASNILIDGHMEGEIWGLATHPSKDLFISASNDGTARIWDLADKKLLNKVSLGHAARCAAYSPDGEMVAIGMKNGEFVILLVNSLKVWGKKRDRKSAIQDIRISPDNRFLAVGSSEHTVDFYDLTQGTNLNRIGYCKDIPSFVIQMDFSADGKYIQVSTGAYKRQVHEVPLGKQVTEAVVIEKITWASWTSVLGDEVIGIWPRNADKADVNCACVTHAGLNIVTGDDFGLVKLFDFPCTEKFAKHKRYFGHSAHVTNIRFSYDDKYVVSTGGDDCSVFVWRCL

SEQ ID NO: 5903 - protein, 209 aa, Homo sapiens; identical to SEQ ID NO: 4749

SEQ ID NO: 5904 - protein, 544 aa, Homo sapiens
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLEGNFWKSGCL

SEQ ID NO: 5905 - protein, 279 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVSKNAKARTRKCSLVSGHGRENKSCRGWGWGQGF

SEQ ID NO: 5906 - protein, 134 aa, Homo sapiens
MSENAAPGLCGELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 5907 - protein, 449 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 5908 - protein, 1358 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 5909 - protein, 330 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPLKSWARCRDF

SEQ ID NO: 5910 - protein, 674 aa, Homo sapiens
MQTSSSRSVHLSEWQKNYFAITSGICTGPKADAYRAQILRIQYAWANSEISQVCATKLFKKYAEKYSAIIDSDNVESGLNNYAENILTLAGSQQTDSDKWQSGLSINNVFKMSSVQKMMQAGKKFKDSLLEPALASVVIHKEATVFDLPKFSVCGSSQESDSLPNSAHDRDRTQDFPESNRLKLLQNAQPPMVTNTARTCPTFSAPVGESATAKFHVTPLFGNVKKENHSSAKENIGLNVFLSNQSCFPAACENPQRKSFYGSGTIDALSNPILNKACSKTEDNGPKEDSSLPTFKTAKEQLWVDQQKKYHQPQRASGSSYGGVKKSLGASRSRGILGKFVPPIPKQDGGEQNGGMQCKPYGAGPTEPAHPVDERLKNLEPKMIELIMNEIMDHGPPVNWEDIAGVEFAKATIKEIVVWPMLRPDIFTGLRGPPKGILLFGPPGTGKTLIGKCIASQSGATFFSISASSLTSKWVGEGEKMVRALFAVARCQQPAVIFIDEIDSLLSQRGDGEHESSRRIKTEFLVQLDGATTSSEDRILVVGATNRPQEIDEAARRRLVKRLYIPLPEASARKQIVINLMSKEQCCLSEEEIEQIVQQSDAFSGADMTQLCREASLGPIRSLQTADIATITPDQVRPIAYIDFENAFRTVRPSVSPKDLELYENWNKTFGCGK

SEQ ID NO: 5911 - protein, 380 aa, Homo sapiens
MLRRKPSNASEKEPTQKKKLSLQRSSSFKDFAKSKPSSPVVSEKEFNLDDNIPEDDSGVPTPEDAGKSGKKLGKKWRAVISRTMNRKMGKMMVKALSEEMADTLEEGSASPTSPDYSLDSPGPEKMALAFSEQEEHELPVLSRQASTGSELCSPSPGSGSFGEEPPAPQYTGPFCGRARVHTDFTPSPYDHDSLKLQKGDVIQIIEKPPVGTWLGLLNGKVGSFKFIYVDVLPEEAVGHARPSRRQSKGKRPKPKTLHELLERIGLEEHTSTLLLNGYQTLEDFKELRETHLNELNIMDPQHRAKLLTAAELLLDYDTGSEEAEEGAESSQEPVAHTVSEPKVDIPRDSGCFEGSESGRDDAELAGTEEQLQGLSLAGAP

SEQ ID NO: 5912 - protein, 563 aa, Homo sapiens
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 5913 - protein, 630 aa, Homo sapiens
MLFLAIPQSIDEETEVWSDHIIFPRIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNEC

SEQ ID NO: 5914 - protein, 137 aa, Homo sapiens
MILPTKAMATQELTVKRKLSGNTLQVQASSPVALGVRIPTVALHMMELFDTTVEQLYSIFTVKELTNKKIIMKWRCGNWPEEHYAMVALNFVPTLGQTELQLKEFLSICKEENMKFCWQKQHFEEIKGSLQLTPLNG

SEQ ID NO: 5915 - protein, 415 aa, Homo sapiens; identical to SEQ ID NO: 5668

SEQ ID NO: 5916 - protein, 487 aa, Homo sapiens
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 5917 - protein, 488 aa, Homo sapiens
MSAFCLGLVGRASAPAEPDSACCMELPAAAGDAVRSPAAAAALIFPGGSGELELALEEELALLAAGERPSDPGEHPQAELLSVIRQKEKDLVLAARLGKALLERNQDMSRQYEQMHKELTDKLEHLEQEKHELRRRFENREGEWEGRVSELESDVKQLQDELERQQIHLREADREKSRAVQELSEQNQRLLDQLSRASEVERQLSMQVHALREDFREKNSSTNQHIIRLESLQAEIKMLSDRKRELEHRLSATLEENDLLQGTVEELQDRVLILERQGHDKDLQLHQSQLELQEVRLSCRQLQVKVEELTEERSLQSSAATSTSLLSEIEQSMEAEELEQEREQLRLQLWEAYCQVRYLCSHLRGNDSADSAVSTDSSMDESSETSSAKDVPAGSLRTALNELKRLIQSIVDGMEPTGSRRLDDDSLEEQIRQTSEDSRALRELMEGERGRLPEASRCCLPACSQPIQSPSLPHVGKAQQGCAARMYL

SEQ ID NO: 5918 - protein, 475 aa, Homo sapiens
MTRGTGGTAQRGRSGPDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 5919 - protein, 436 aa, Homo sapiens
MADGGSERADGRIVKMEVDYSATVDQRLPECAKLAKASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 5920 - protein, 657 aa, Homo sapiens
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 5921 - protein, 204 aa, Homo sapiens; identical to SEQ ID NO: 4831

SEQ ID NO: 5922 - protein, 1013 aa, Homo sapiens
MGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 5923 - protein, 684 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 5924 - protein, 1191 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 5925 - protein, 699 aa, Homo sapiens
MCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 5926 - protein, 688 aa, Homo sapiens
MSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 5927 - protein, 435 aa, Homo sapiens
MSGYQRRPGATPLSRARSLAIPDAPAFYERRSCLPQLNCERPHGRDLDSPFFGIRPAFMCYVPSPVLASVGDTDFGYGKGKCSKQSPSGAHGTHFGDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 5928 - protein, 196 aa, Homo sapiens
MKVKIKCWNGVATWLWVANDENCGICRMAFNGCCPDCPLHGESISRCLGWCPQPVPVLGGRAHPQVPINTASPTPGQHTGSLMSREESSRSPDPTPPALDQETSSLLRCTSPWCLDHSCDLFGITDQVSADGPRACRQGARRRLPAGVGPVLPLLPHALHPQVAARTAGAAALPHVPPGMEVQGVRPDLALAGGAS

SEQ ID NO: 5929 - protein, 1708 aa, Homo sapiens
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELERILAPYTDFHYRHSPDTAEGQLKEDREARFLASKMGIIATFRSWAGIINLCKPGNSGIQSLIGVLCIPNMEIRRGLLEVLYDIFRLPLPVVTEEFIEALLSVDPGRFQDSWRLSDGFVAAEAKTILPHRARSRPDLMDNYLALILSAFIRNGLLEGLVEVITNSDDHISVRATILLGELLHMANTILPHSHSHHLHCLPTLMNMAASFDIPKEKRLRASAALNCLKRFHEMKKRGPKPYSLHLDHIIQKAIATHQKRDQYLRVQKDIFILKDTEEALLINLRDSQVLQHKENLEWNWNLIGTILKWPNVNLRNYKDEQLHRFVRRLLYFYKPSSKLYANLDLDFAKAKQLTVVGCQFTEFLLESEEDGQGYLEDLVKDIVQWLNASSGMKPERSLQNNGLLTTLSQHYFLFIGTLSCHPHGVKMLEKCSVFQCLLNLCSLKNQDHLLKLTVSSLDYSRDGLARVILSKILTAATDACRLYATKHLRVLLRANVEFFNNWGIELLVTQLHDKNKTISSEALDILDEACEDKANLHALIQMKPALSHLGDKGLLLLLRFLSIPKGFSYLNERGYVAKQLEKWHREYNSKYVDLIEEQLNEALTTYRKPVDGDNYVRRSNQRLQRPHVYLPIHLYGQLVHHKTGCHLLEVQNIITELCRNVRTPDLDKWEEIKKLKASLWALGNIGSSNWGLNLLQEENVIPDILKLAKQCEVLSIRGTCVYVLGLIAKTKQGCDILKCHNWDAVRHSRKHLWPVVPDDVEQLCNELSSIPSTLSLNSESTSSRHNSESESVPSSMFILEDDRFGSSSTSTFFLDINEDTEPTFYDRSGPIKDKNSFPFFASSKLVKNRILNSLTLPNKKHRSSSDPKGGKLSSESKTSNRRIRTLTEPSVDFNHSDDFTPISTVQKTLQLETSFMGNKHIEDTGSTPSIGENDLKFTKNFGTENHRENTSRERLVVESSTSSHMKIRSQSFNTDTTTSGISSMSSSPSRETVGVDATTMDTDCGSMSTVVSTKTIKTSHYLTPQSNHLSLSKSNSVSLVPPGSSHTLPRRAQSLKAPSIATIKSLADCNFSYTSSRDAFGYATLKRLQQQRMHPSLSHSEALASPAKDVLFTDTITMKANSFESRLTPSRFMKALSYASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASSTKSTELLLGVKTIPDDTPMCRILLRKEVLRLVINLSSSVSTKCHETGLLTIKEKYPQTFDDICLYSEVSHLLSHCTFRLPCRRFIQELFQDVQFLQMHEEAEAVLATPPKQPIVDTSAES

SEQ ID NO: 5930 - protein, 1288 aa, Homo sapiens; identical to SEQ ID NO: 5775

SEQ ID NO: 5931 - protein, 942 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 5932 - protein, 701 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKRPAPARPTMPPPQVSGSRSSPPAPPLPPGSGSPGTPQALPRRLVGSSLRAPTVPPPLPPTPPQPARRQSRRSPASPSPASPGPASPSPVSLSNPAQVDLGAATAEGGAPEAISGVPTPPAIPPQPRPRSLASETN

SEQ ID NO: 5933 - protein, 605 aa, Homo sapiens
MEVRASLQKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKQQMKFSLTPRQTIHLVKYEGSMKVSMTPCNQLQFDIRLDVLITYTFCFSSFPEPELYKYVLKHQLIKRLNAC

SEQ ID NO: 5934 - protein, 1039 aa, Homo sapiens
MAVQLVPDSALGLLMMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 5935 - protein, 1075 aa, Homo sapiens
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLTNGVTAGNGDNGLIPQRKSRTPENQQFPDNESEEYHRICELLSDYKEKQMPKYSSENSNPEQDLKLTSEEESQRLKGSENGQPEKRSQEPEINKDGDRELENFMAIEEMKKHRSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDILHENSTLREEIAMLRLELDTMKHQSQLREKKYLEDIESVKKRNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPVLLTEATLNPKANREKMTQIMFETFNTPAMYVAIQAVLSLYTSGRTTGIVMDSGDGVTHTVPIYEGNALPHATLRLDLAGRELPDYLMKILTEHGYRFTTMAEREIVRDIKEKLCYVALDFEQEMATVASSSSLEKSYELPDGQVITIGNERFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCL

SEQ ID NO: 5936 - protein, 583 aa, Homo sapiens
MLSESKEGEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5937 - protein, 320 aa, Homo sapiens; identical to SEQ ID NO: 5744

SEQ ID NO: 5938 - protein, 1097 aa, Homo sapiens
MAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 5939 - protein, 904 aa, Homo sapiens
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESRNSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 5940 - protein, 262 aa, Homo sapiens
MALSLGWKAHRNHCGLLLQALRSSGLLLFPCGQCPWRGAGSFLDPEIKAFLEENTEVTSSGSLTPEIQLRLLTPRCKFWWERADLWPHSDPYWAIYWPGGQALSRYLLDNPDVVRGKSVLDLGSGCGATAIAAKMSGASRILANDIDPIAGMAITLNCELNRLNPFPILIQNILNLEQDKWDLVVLGDMFYDEDLADSLHQWLKKCFWTYRTRVLIGDPGRPQFSGHSIQHHLHKVVEYSLLESTRQENSGLTTSTVWGFQP

SEQ ID NO: 5941 - protein, 872 aa, Homo sapiens
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 5942 - protein, 486 aa, Homo sapiens
MVSHTFHMRTEESDASQEGDDLPKSSANTSHPKQDDSPKSSEETIQPKEGDIPKAPEETIQSKKEDLPKSSEKAIQPKESNIPKSSAKPIQPKLGNIPKASVKPSQPKEGDIPKAPEETIQSKKEDLPKSSEEAIQPKEGDIPKSSAKPIQPKLGNIAKTSVKPSQPKESDIPKSPEETIQPKEGDIPKSSAKPIQPKLGNIPKASVKPSQPKEGDISKSPEEAIQPKEGDLPKSLEEAIQPKEGDIPKSPEEAIQPKEGDIPKSLEEAIQPKEGDIPKSPEETIQPKKGDIPKSPEEAIQPKEGDIPKSPKQAIQPKEGDIPKSLEEAIPPKEIDIPKSPEETIQPKEDDSPKSLEEATPSKEGDILKPEEETMEFPEGDKVKVILSKEDFEASLKEAGERLVAVDFSATWCGPCRTIRPFFHALSVKHEDVVFLEVDADNCEEVVRECAIMCVPTFQFYKKEEKVDELCGALKEKLEAVIAELK

SEQ ID NO: 5943 - protein, 334 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 5944 - protein, 449 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 5945 - protein, 110 aa, Homo sapiens
MEEIPAQEAAGSPRVQFQSLETQSECLSPEPQFVQDTDMEQGLTGGILLRLPTTRIHSVNSCPALSHTQASAFSGETLAVLTAGISKRWPKYRLPIDIARPCSETPFPRL

SEQ ID NO: 5946 - protein, 273 aa, Homo sapiens; identical to SEQ ID NO: 5514

SEQ ID NO: 5947 - protein, 971 aa, Homo sapiens
LSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERMATTGTPTADRGDAAATDDPAARFQVQKHSWDGLRSIIHGSRKYSGLIVNKAPHDFQFVQKTDESGPHSHRLYYLGMPYGSRENSLLYSEIPKKVRKEALLLLSWKQMLDHFQATPHHGVYSREEELLRERKRLGVFGITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 5948 - protein, 863 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 5949 - protein, 420 aa, Homo sapiens; identical to SEQ ID NO: 5350

SEQ ID NO: 5950 - protein, 826 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 5951 - protein, 383 aa, Homo sapiens
MDRTCEERPAEDGSDEEDPDSMEAPTRIRDTPEDIVLEAPASGLAFHPARDLLAAGDVDGDVFVFSYSCQEGETKELWSSGHHLKACRAVAFSEDGQKLITVSKDKAIHVLDVEQGQLERRVSKAHGAPINSLLLVDENVLATGDDTGGICLWDQRKEGPLMDMRQHEEYIADMALDPAKKLLLTASGDGCLGIFNIKRRRFELLSEPQSGDLTSVTLMKWGKKVACGSSEGTIYLFNWNGFGATSDRFALRAESIDCMVPVTESLLCTGSTDGVIRAVNILPNRVVGSVGQHTGEPVEELALSHCGRFLASSGHDQRLKFWDMAQLRAVVVDDYRRRKKKGGPLRALSSKTWSTDDFFAGLREEGEDSMAQEEKEETGDDSD

SEQ ID NO: 5952 - protein, 332 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 5953 - protein, 914 aa, Homo sapiens; identical to SEQ ID NO: 5366

SEQ ID NO: 5954 - protein, 923 aa, Homo sapiens
MAASTGYVRLWGAARCWVLRRPMLAAAGGRVPTAAGAWLLRGQRTCDASPPWALWGRGPAIGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 5955 - protein, 226 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNEDITEPQSILAAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 5956 - protein, 684 aa, Homo sapiens
MEANHSEQLSAERQSTPPGDSSSLPSHNGLEKEDGQDSPTPVQPPEKEASVHPDISEELNRQLEDIINTYGSAASTAGKEGSARASEQPENAESPDNEDGDCEETTEEAGREPVASGEPPTVKEPVSNKEQKLEKKILKGLGKEANLLMQNLNKLQTPEEKFDFLFKKYAELLDEHRTEQKKLKLLQKKQVQIQKEKDQLQGEHSRAILARSKLESLCRELQRHNKTLKEEALQRAREEEEKRKEITSHFQSTLTDIQGQIEQQSERNMKLCQENTELAEKLKSIIDQYELREEHLDKIFKHRELQQKLVDAKLEQAQEMMKEAEERHKREKEYLLNQAAEWKLQAKVLKEQETVLQAQLTLYSGRFEEFQSTLTKSNEVFATFKQEMDKTTKKMKKLEKDTATWKARFENCNKALLDMIEEKALRAKEYECFVMKIGRLENLCRALQEERNELHKKIRDAEISEKDDQSQHNSDEEPESNVSVDQEIDAEEVNSVQTAVKNLATAFMIIHHPESTPHQSKETQPEIGSSQESADAALKEPEQPPLIPSRDSESPLPPLTPQAEAEGGSDAEPPSKASNSPAGLGAETQCEGLPVGAQADQASWKPEAEASGQAPQAPTEASLQKMEADVPAPACAAEEHVAAMVPACEPSRQPPRAAAEELPVGASAGPQPRNVADTNLEGVD

SEQ ID NO: 5957 - protein, 486 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 5958 - protein, 2603 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTSSKRKNRKNKITPENVQIIFDDPLPISYSQPEKVNGESKSSSTSESGDSDNMRISSCSDESSNSNSSRKSDNHSPAVVTTTVSSKKQPSVLVTFPKEERKSVSGKASIKLSETISEGTSNSLSTCTKSGPSPLSSPNGKLTVASPKRGQKREEGWKEVVRRSKKVSVPSTVISRVIGRGGCNINAIREFTGAHIDIDKQKDKTGDRIITIRGGTESTRQATQLINALIKDPDKEIDELIPKNRLKSSSANSKIGSSAPTTTAANTSLMGIKMTTVALSSTSQTATALTVPAISSASTHKTIKNPVNNVRPGFPVSLPLAYPPPQFAHALLAAQTFQQIRPPRLPMTHFGGTFPPAQSTWGPFPVRPLSPARATNSPKPHMVPRHSNQNSSGSQVNSAGSLTSSPTTTTSSSASTVPGTSTNGSPSSPSVRRQLFVTVVKTSNATTTTVTTTASNNNTAPTNATYPMPTAKEHYPVSSPSSPSPPAQPGGVSRNSPLDCGSASPNKVASSSEQEAGSPPVVETTNTRPPNSSSSSGSSSAHSNQQQPPGSVSQEPRPPLQQSQVPPPEVRMTVPPLATSSAPVAVPSTAPVTYPMPQTPMGCPQPTPKMETPAIRPPPHGTTAPHKNSASVQNSSVAVLSVNHIKRPHSVPSSVQLPSTLSTQSACQNSVHPANKPIAPNFSAPLPFGPFSTLFENSPTSAHAFWGGSVVSSQSTPESMLSGKSSYLPNSDPLHQSDTSKAPGFRPPLQRPAPSPSGIVNMDSPYGSVTPSSTHLGNFASNISGGQMYGPGAPLGGAPAAANFNRQHFSPLSLLTPCSSASNDSSAQSVSSGVRAPSPAPSSVPLGSEKPSNVSQDRKVPVPIGTERSARIRQTGTSAPSVIGSNLSTSVGHSGIWSFEGIGGNQDKVDWCNPGMGNPMIHRPMSDPGVFSQHQAMERDSTGIVTPSGTFHQHVPAGYMDFPKVGGMPFSVYGNAMIPPVAPIPDGAGGPIFNGPHAADPSWNSLIKMVSSSTENNGPQTVWTGPWAPHMNSVHMNQLG

SEQ ID NO: 5959 - protein, 1024 aa, Homo sapiens
MTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 5960 - protein, 287 aa, Homo sapiens
MSQAWWHTSVSPATQEAKAGGLLQPRRQRLWLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 5961 - protein, 204 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 5962 - protein, 172 aa, Homo sapiens
MMKLKSNQTRTYDGDGYKKRAACLCFRSESEEEVLLVSSSRHPDRWIVPGGGMEPEEEPSVAAVREVCEEAGVKGTLGRLVGIFENQERKHRTYVYVLIVTEVLEDWEDSVNIGRKREWFKIEDAIKVLQYHKPVQASYFETLRQGYSANNGTPVVATTYSVSAQSSMSGIR

SEQ ID NO: 5963 - protein, 1427 aa, Homo sapiens; identical to SEQ ID NO: 5224

SEQ ID NO: 5964 - protein, 392 aa, Homo sapiens
MGDSCPAVTFRSQKENRAGLQEKLRYLQQQLQDETPRRQEAELQEPEEKQEPEEKQEPEEKQKPEAGLSWNSLGPAATSQGCPGPPGSPDKPSRPHGLVPAGWGMGPRAGEGPYVSEQELQKLFTGIEELRREVSSLTARWHQEEGAVQEALRLLGGLGGRVDGFLGQWERAQREQAQTARDLQELRGRADELCTMVERSAVSVASLRSELEGLGPLKPILEEFGRQFQNSRRGPDLSMNLDRSHQGNCARCASQGSQLSTESLQQLLDRALTSLVDEVKQRGLTPACPSCQRLHKKILELERQALAKHVRAEALSSTLRLAQDEALRAKNLLLTDKMKPEEKMATLDHLHLKMCSLHDHLSNLPLEGSTGTMGGGSSAGTPPKQGGSAPEQ

SEQ ID NO: 5965 - protein, 563 aa, Homo sapiens
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 5966 - protein, 418 aa, Homo sapiens
MFSPDQENHPSKAPVKYGELIVLGYNGSLPNGDRGRRKSRFALFKRPKANGVKPSTVHIACTPQAAKAISNKDQHSISYTLSRAQTVVVEYTHDSNTDMFQIGRSTESPIDFVVTDTVPGSQSNSDTQSVQSTISRFACRIICERNPPFTARIYAAGFDSSKNIFLGEKAAKWKTSDGQMDGLTTNGVLVMHPRNGFTEDSKPGIWREISVCGNVFSLRETRSAQQRGKMVEIETNQLQDGSLIDLCGATLLWRTAEGLSHTPTVKHLEALRQEINAARPQCPVGFNTLAFPSMKRKDVVDEKQPWVYLNCGHVHGYHNWGNKEERDGKDRECPMCRSVGPYVPLWLGCEAGFYVDAGPPTHAFSPCGHVCSEKTTAYWSQIPLPHGTHTFHAACPFCAHQLAGEQGYIRLIFQGPLD

SEQ ID NO: 5967 - protein, 1320 aa, Homo sapiens
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 5968 - protein, 1401 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 5969 - protein, 191 aa, Homo sapiens
MSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFNNVM

SEQ ID NO: 5970 - protein, 873 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQGTNLPPSRQIVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVMNKKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 5971 - protein, 1036 aa, Homo sapiens
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLSLQGNTVRDDGARSMAEALASNRTLSMLHLQKNSIGPMGAQRMADLKQNRSLKELMFSSNSIGDGGAKALAEALKVNQGLESLDLQSNSISDAGVAALMGALCTNQTLLSLSLRENSISPEGAQAIAHALCANSTLKNLDLQWNFIQAGAAQALGQALQLNRSLTSLDLQENAIGDDGACAVARALKVNTALTALYLQVASIGASGAQVLGEALAVNRTLEILDLRGNAIGVAGAKALANALKVNSSLRRLNLQENSLGMDGAICIATALSGNHRLQHINLQGNHIGDSGARMISEAIKTNAPTCTVEM

SEQ ID NO: 5972 - protein, 927 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEAGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGQMPRQKELP

SEQ ID NO: 5973 - protein, 739 aa, Homo sapiens
MGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 5974 - protein, 636 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKLRFPCRITESKNMNILIVLDMLCYISSEKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSDPETP

SEQ ID NO: 5975 - protein, 290 aa, Homo sapiens
MAAVEKRRQAVPPPAGFTDSGRQSVSRAAGAAESEEDFLRQVGVTEMLRAALLKVLEARPEEPIAFLAHYFENMGLRSPVNGGAGEPPGQLLLQQQRLGRALWHLRLAHHSQRAAFNNNVSVAYECLSAGGRRKRPGLDGRTYSELLRRICRDGQAPEEVVAPLLRKVQCRDHEAVPLSVFRAGTLTCFVLLEFVARAGALFQLLEDSAAAVADRRVGQAVLDTLEGALQASDAAAPARFLEAGSRLGPDSLALALDRAVGGRRPSAPMTREEFLERAAALFIAKVKPVG

SEQ ID NO: 5976 - protein, 406 aa, Homo sapiens
MADSQLFCVAEERSGHCAVVDGNFLYVWGGYVSIEDNEVYLPNDEIWTYDIDSGLWRMHLMEGELPASMSGSCGACINGKLYIFGGYDDKGYSNRLYFVNLRTRDETYIWEKITDFEGQPPTPRDKLSCWVYKDRLIYFGGYGCRRHSELQDCFDVHDASWEEQIFWGWHNDVHIFDTKTQTWFQPEIKGGVPPQPRAAHTCAVLGNKGYIFGGRVLQTRMNDLHYLNLDTWTWSGRITINGESPKHRSWHTLTPIADDKLFLCGGLSADNIPLSDGWIHNVTTNCWKQLTHLPKTRPRLWHTACLGKENEIMVFGGSKDDLLALDTGHCNDLLIFQTQPYSLLRSCLDCIGKNSIMLESQISLLPPKLLQQVLKKITFWAAANHREEQRVQKEETENKYQWISSN

SEQ ID NO: 5977 - protein, 370 aa, Homo sapiens
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYIESANCFRSNRVDMQPTDMHSLLLQPQPPLLQPLQPLTVTVMAGCTQPTPTMPLPLPLAMELALWRVYTEVATADLPPTEVT

SEQ ID NO: 5978 - protein, 177 aa, Homo sapiens
MSEDSEKEDYSDRTISDEDESDEDMFMKFVSEDLHRCALLTADSFGDPFFPRTTQILLEYQLGRWVPRLREPRDLYGVSSSGPLSPTRWPYHCEVIDEKVQHIDGVSCWSESHQAGAQWCDLGSLQPPPPRFKRFACFSLLSSRDYRRVPPRSANFVFLVETGFHHVGQDGLRLLTS

SEQ ID NO: 5979 - protein, 608 aa, Homo sapiens
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 5980 - protein, 208 aa, Homo sapiens
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLKRPSRENQVTTLPQSAVSLRSCWTVMM

SEQ ID NO: 5981 - protein, 329 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 5982 - protein, 294 aa, Homo sapiens
MSQPAGGRRKPRTLGPPVCSIRPFKSSEQYLEAMKEDLAEWLRDLYGLDIDAANFLQVLETGLVLCQHANVVTDAALAFLAEAPAQAQKIPMPRVGVSCNGAAQPGTFQARDNVSNFIQWCRKEMGIQEVLMFETEDLVLRKNVKNVVLCLLELGRRAWRFGVAAPTLVQLEEEIEEEVRRELALPPLPQPGPDGAEPCEPLHVPSAVLHGQSVYVFLGPARQPPKDRLLRAVLGSKGGEASRVDGASVGEEEEEGKEEKEPAAPLESSPQPPEGLQPHWLNQAPLPPEEESWV

SEQ ID NO: 5983 - protein, 517 aa, Homo sapiens; identical to SEQ ID NO: 5333

SEQ ID NO: 5984 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 5985 - protein, 2757 aa, Homo sapiens
EPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPAHREVQAEAGASATLSCEVAQAQTEVTWYKDGKKLSSSLKVHVEAAGCTRRLVVQQAGQADTGEYSCEAGGQQLSFRLQVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAEPKAVFAKEQVVFAKDQPVHREVQAEAGTSTMLSCEVAQAQTEVMWYKDGKKLSSSSKMRVEAVGCTRRLVVQEAGQADAGEYSCEAGGQRLSFHLHVAEPKVVFAKEQPACREVQAEAGASATLSCEVAQGQMEVTWYKDGKKLSSSSKVHMEASGYTRRLVVQQAGQADAGEYSCEAGGQRLSFRLHVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARHSRSEDQGGLRRGHSYTAV

SEQ ID NO: 5986 - protein, 482 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGIPPHVKAPVSQPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 5987 - protein, 268 aa, Homo sapiens
MSGRKRSFTFGAYGGVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQ

SEQ ID NO: 5988 - protein, 201 aa, Homo sapiens; identical to SEQ ID NO: 5466

SEQ ID NO: 5989 - protein, 568 aa, Homo sapiens
MGLLTFRDVAIEFSLEEWQCLDTAQRNLYKNVILENYRNLVFLGIAVSKQDLITCLEQEKEPLTVKRHEMVNEPPVMCSHFAQEFWPEQNIKDSFEKVTLRRYEKCGNDNFQLKGCKSVDECKLHKGGYNGLNQCLPTMQSKMFQCDKYVKVFNKFSHSDRHKIKHMENKPFKCKECGRSFCMLSHLTRHERNYTKVNFCKCEECEKAVNQSSKLTKHKRIYTCEKLYKCQECDRTFNQFSNLTEYKKDYAREKPYKCEECGKAFNQSSHLTTHKIIHTGEKPYKCEECGKAFNQFSNLTTHKKIHTGEQPYICEECGKAFTQSSTLTTHKRIHTGEKPYKCEECGKAFNRSSKLTEHKNIHTGEQPYKCEECGKAFNRSSNLTEHRKIHTEEKPYKCKECGKAFKHSSALTTHKRIHTGEKPYKCEECGKAFNRSSKLTEHKKLHTGKKPYKCEECGKAFIQSSKLTEHKKIHSGEIPYKCEECGKAFKHSSSLTTHKRIHTGEKPYKCEECGKAFSRSSKLTEHKIIHTGEKPYKCERCDKAFNQSANLTKHKKIHTGEKLQNWNV

SEQ ID NO: 5990 - protein, 460 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVCKLQQKVQNSKMSEASGIQQEDSYPKGSKNIKNSPRKCLTDTNLFQKNSSFHPIRVHNLQMKLRRDDIMWEQ

SEQ ID NO: 5991 - protein, 610 aa, Homo sapiens
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 5992 - protein, 151 aa, Homo sapiens
MSKNTVSSARFRKVDVDEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFESPSDNSSAMLLQWHEKALAAGGVGSIVRVLTARKTV

SEQ ID NO: 5993 - protein, 1173 aa, Homo sapiens
MVTVGTNILPSRPAASANTAREDAALFSRRIPPRHKNGAAQPGAAPGPGAPGANMGNAHSKSGDRHSALPGRPELSFYGSFPRKWSENVFLDNELLTSKILSVLRPQSERGFRAGDLRYPTHFLSTNSVLASVTASLKEHPRGTLLSDGSPALSRNVGMTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 5994 - protein, 557 aa, Homo sapiens
MDSTVPSALELPQRLALNPRESPRSPEEEEPHLLSSLAAVQTLASVIRPCYGPHGRQKFLVTMKGETVCTGCATAILRALELEHPAAWLLREAGQTQAENSGDGTAFVVLLTEALLEQAEQLLKAGLPRPQLREAYATATAEVLATLPSLAIQSLGPLEDPSWALHSVMNTHTLSPMDHLTKLVAHACWAIKELDGSFKPERVGVCALPGGTLEDSCLLPGLAISGKLCGQMATVLSGARVALFACPFGPAHPNAPATARLSSPADLAQFSKGSDQLLEKQVGQLAAAGINVAVVLGEVDEETLTLADKYGIVVIQARSWMEIIYLSEVLDTPLLPRLLPPQRPGKCQRVYRQELGDGLAVVFEWECTGTPALTVVLRGATTQGLRSAEQAVYHGIDAYFQLCQDPRLIPGAGATEMALAKMLSDKGSRLEGPSGPAFLAFAWALKYLPKTLAENAGLAVSDVMAEMSGVHQGGNLLMGVGTEGIINVAQEGVWDTLIVKAQGFRAVAEVVLQLVTVDEIVVAKKSPTHQEIWNPDSKKTKKHPPPVETKKILGLNN

SEQ ID NO: 5995 - protein, 312 aa, Homo sapiens
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEHPSCMRISTPPRRMQSQQERLQGLTWQGEDPSQFLKAHQMIPITLWLMTTVCSISKINETRAFSG

SEQ ID NO: 5996 - protein, 1230 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 5997 - protein, 886 aa, Homo sapiens
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQARPRLGRGSPPTRRGMKGSSGPTSPTPRTRESSELELGSCSATPGLPQARPPRPRSAPAFSPISCSLSDSPSWNCYSRGPLGQPEVCFVPKSPPLTVSPRV

SEQ ID NO: 5998 - protein, 1406 aa, Homo sapiens; identical to SEQ ID NO: 5816

SEQ ID NO: 5999 - protein, 435 aa, Homo sapiens
MGDLELLLPGEAEVLVRGLRSFPLREMGSEGWNQQHENLEKLNMQAILDATVSQGEPIQELLVTHGKVPTLVEELIAVEMWKQKVFPVFCRVEDFKPQNTFPIYMVVHHEASIINLLETVFFHKEVCESAEDTVLDLVDYCHRKLTLLVAQSGCGGPPEGEGSQDSNPMQELQKQAELMEFEIALKALSVLRYITDCVDRQWSVSQPPQLAHLKRIQRLHPVCWFLSPGKLQQFEGSRWHTVAPSEQQKLSKLDGQVWIALYNLLLSPEAQARYCLTSFAKGRLLKLRAFLTDTLLDQLPNLAHLQSFLAHLTLTETQPPKKDLVLEQIPEIWERLERENRGKWQAIAKHQLQHVFSPSEQDLRLQARRWAETYRLDVLEAVAPERPRCAYCSAEASKRCSRCQNEWYCCRECQVKHWEKHGKTCVLAAQGDRAK

SEQ ID NO: 6000 - protein, 458 aa, Homo sapiens
MNEAMATDSPRRPSRCTGGVVVRPQAVTEQSYMESVVTFLQDVVPQVYCCGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPQPLNGMNCSHRLMQTTLCSSLQMQYSIISSCLLAWFPLEVLGPLLDMGLTTV

SEQ ID NO: 6001 - protein, 102 aa, Homo sapiens
MRASPCISQPAASWHPRPSALRPTAGSGPDTRTPGTVEDGSAPCPAFRSPAVSPCGEEPCCFQISPAEETLELGRLVSPGCHKSSAPQERRLDPRARCVVHI

SEQ ID NO: 6002 - protein, 1408 aa, Homo sapiens; identical to SEQ ID NO: 5616

SEQ ID NO: 6003 - protein, 997 aa, Homo sapiens
RPPPAGPQAPEGARAGSRPVQLLALLSSWCEELGRLLLLRHQKSRQSDPPGKLPMQPPLSSMSSMKPTLSHSDGSFPYDSVPWQQNTNQPPGSLSVVTTVWGVTNTSQSQVLGNPMANANNPMNPGGNPMASGMTTSNPGLNSPQFAGQQQQFSAKAGPAQPYIQQSMYGRPNYPGSGGFGASYPGGPNAPAGMGIPPHTRPPADFTQPAAAAAAAAVAAAAATATATATATVAALQETQNKDINQYGPMGPTQAYNSQFMNQPGPRGPASMGGSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPANHNDELRLTFPVRDGVVLEPFRLEHNLAVSNHVFHLRPTVHQTLMWRSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKIKRNFSSVAASSGNTTLNGEDGVEQTAIKVSLKCPITFRRIQLPARGHDCKHVQCFDLESYLQLNCERGTWRCPVCNKTALLEGLEVDQYMWGILNAIQHSEFEEVTIDPTCSWRPVPIKSDLHIKDDPDGIPSKRFKTMSPSQMIMPNVMEMIAALGPGPSPYPLPPPPGGTNSNDYSSQGNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 6004 - protein, 1134 aa, Homo sapiens
MGKEQELLEAARTGHLPAVEKLLSGKRLSSGFGGGGGGGSGGGGGGSGGGGGGLGSSSHPLSSLLSMWRGPNVNCVDSTGYTPLHHAALNGHKDVVEVLLRNDALTNVADSKGCYPLHLAAWKGDAQIVRLLIHQGPSHTRVNEQNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDHMTGKRSTKEVDKTPPPQPPLISSMDSISQKSQGDVEKAVTELIIDFDANAEEEGPYEALYNAISCHSLDSMASGRSSDQDSTNKEAEAAGVKPAGVRPRERPPPPAKPPPDEEEEDHIDKKYFPLTASEVLSMRPRIHGSAAREEDEHPYELLLTAETKKVVLVDGKTKDHRRSSSSRSQDSAEGQDGQVPEQFSGLLHGSSPVCEVGQDPFQLLCTAGQSHPDGSPQQGACHKASMQLEETGVHAPGASQPSALDQSKRVGYLTGLPTTNSRSHPETLTHTASPHPGGAEEGDRSGARSRAPPTSKPKAELKLSRSLSKSDSDLLTCSPTEDATMGSRSESLSNCSIGKKRLEKSPSFASEWDEIEKIMSSIGEGIDFSQERQKISGLRTLEQSVGEWLESIGLQQYESKLLLNGFDDVHFLGSNVMEEQDLRDIGISDPQHRRKLLQAARSLPKVKALGYDGNSPPSVPSWLDSLGLQDYVHSFLSSGYSSIDTVKNLWELELVNVLKVQLLGHRKRIIASLADRPYEEPPQKPPRFSQLRCQDLLSQTSSPLSQNDSCTGRSADLLLPPGDTGRRRHDSLHDPAAPSRAERFRIQEEHREAKLTLRPPSLAAPYAPVQSWQHQPEKLIFESCGYEANYLGSMLIKDLRGTESTQDACAKMRKSTEHMKKIPTIILSITYKGVKFIDASNKNVIAEHEIRNISCAAQDPEDLCTFAYITKDLQTSHHYCHVFSTVDVNLTYEIILTLGQAFEVAYQLALQAQKSRATGASAAEMIETKSSKPVPKPRVGVRKSALEPPDMDQDAQSHASVSWVVDPKPDSKRSLSTN

SEQ ID NO: 6005 - protein, 1032 aa, Homo sapiens
MEAAAAVVAAEAEVENEDGDSSCGDVCFMDKGLQSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 6006 - protein, 72 aa, Homo sapiens
MSYQQQQCKQPCQPPPVCPTPKCPEPCPPPKCPEPCPSPKCPQPCPPQQCQQKYPPVTPSPPCQPKCPPKSK

SEQ ID NO: 6007 - protein, 295 aa, Homo sapiens; identical to SEQ ID NO: 5678

SEQ ID NO: 6008 - protein, 496 aa, Homo sapiens; identical to SEQ ID NO: 5715

SEQ ID NO: 6009 - protein, 524 aa, Homo sapiens
MSSCVSSQPSSNRAAPQDELGGRGSSSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKQGSEDNLQGTDPPPVGEEEVLL

SEQ ID NO: 6010 - protein, 633 aa, Homo sapiens
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 6011 - protein, 172 aa, Homo sapiens
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQEGKPRVTPLLAKN

SEQ ID NO: 6012 - protein, 978 aa, Homo sapiens
MGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 6013 - protein, 357 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 6014 - protein, 210 aa, Homo sapiens
MSCPNYCSGNSNSGSLRTSRHIPLTSIDLCPTSVSCGDVLYLPTSSQDHTWVTDNCQETCGEPTSCQPVHCETGNLETSCGSSTAYYVPRPCQGSSFLPASFFSSSCLPVSCRPQRYVSSGCRPLRPLLNSYQPIGDCVPNAYRPQFCLSKSCQPQNLLTSGCQPSSCLAYRPQSLHVVSSSLRPLGPLFSGCQPLTHVFSTCRPSCSGL

SEQ ID NO: 6015 - protein, 201 aa, Homo sapiens
MASGDDSPIFEDDESPPYSLEKMTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 6016 - protein, 1129 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 6017 - protein, 491 aa, Homo sapiens
SGSSHSFPGSLEVTALMTTWSSLQGSHVSKRALAYALVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEVLRLVGYSRNLAPLNVIL

SEQ ID NO: 6018 - protein, 326 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGVPESCDLRLCTLDPDDVASTTSSSESL

SEQ ID NO: 6019 - protein, 959 aa, Homo sapiens
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 6020 - protein, 400 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 6021 - protein, 874 aa, Homo sapiens
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPPSHLYSSTTVLKYQKGNCFDFSTLLCSMLIGSGYDAYCVNGYGSLDLCHMDLTREVCPLTVKPKETIKKEEKVLPKKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKDLIFDLGDPVRWEYMLLGTDKSQLSLTEEDDSGINDEDDVENLGKEDEDKSFDMPHSWVEQIEISPEAFETRCPNGKKVIQYKRAKLEKWAPYLNSNGLVSRLTTYEDLQCTNILEIKEWYQNREDMLELKHINKTTDLKTDYFKPGHPQALRVHSYKSMQPEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 6022 - protein, 616 aa, Homo sapiens
MDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGEKPYVCNECGKSFSYKRNLIVHQRTHKGENIEMQ

SEQ ID NO: 6023 - protein, 146 aa, Homo sapiens
MCHTSCSSGCQPACCAPSPCQPACCVPSSCQASCCVPVGCQSSVCVPVSFKPAVCLPVSCQSSVCVPMSFKSAVCVPVSCQSSVCVPVSCRPIVCAAPSCQSSLCVPVSCRPVVYAAPSCQSSGCCQPSCTSVLCRPISYSISSCC

SEQ ID NO: 6024 - protein, 418 aa, Homo sapiens; identical to SEQ ID NO: 5718

SEQ ID NO: 6025 - protein, 1116 aa, Homo sapiens
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELERQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 6026 - protein, 1024 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 6027 - protein, 354 aa, Homo sapiens
MAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 6028 - protein, 828 aa, Homo sapiens
MDSEAFQSARDFLDMNFQSLAMKHMDLKQMELDTAAAKVDELTKQLESLWSDSPAPPGPQAGPPSRPPRYSSSSIPEPFGSRGSPRKAATDGADTPFGRSESAPTLHPYSPLSPKGRPSSPRTPLYLQPDAYGSLDRATSPRPRAFDGAGSSLGRAPSPRPGPGPLRQQGPPTPFDFLGRAGSPRGSPLAEGPQAFFPERGPSPRPPATAYDAPASAFGSSLLGSGGSAFAPPLRAQDDLTLRRRPPKAWNESDLDVAYEKKPSQTASYERLDVFARPASPSLQLLPWRESSLDGLGGTGKDNLTSATLPRNYKVSPLASDRRSDAGSYRRSLGSAGPSGTLPRSWQPVSRIPMPPSSPQPRGAPRQRPIPLSMIFKLQNAFWEHGASRAMLPGSPLFTRAPPPKLQPQPQPQPQPQSQPQPQLPPQPQTQPQTPTPAPQHPQQTWPPVNEGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 6029 - protein, 376 aa, Homo sapiens
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPG

SEQ ID NO: 6030 - protein, 254 aa, Homo sapiens
MPASFPMLRCARSPCWTVCWSPWCRALPDGRCSCLSSPPSPLGPTRDPVATFLETCREPGSQPAGPASLRAEYLPPSVASIKVSAELLRAALKDGHSGVPLCCATLQWLLAENAAVDVVRARALSSIQGVAPDGANVHLIVREVAMTDLCPAGPIQAVEIQVESSSLADICRAHHAVVGRMQTMVTEQATQGSSAPDLRVQYLRQIHANHETLLREVQTLRDRLCTEDEASSCATAQRLLQVYRQLRHPSLILL

SEQ ID NO: 6031 - protein, 681 aa, Homo sapiens
MCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 6032 - protein, 165 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLSWEPLLKAPSPFTISTTPSFRPCSNPVT

SEQ ID NO: 6033 - protein, 210 aa, Homo sapiens
MAASVEQREGTIQVQGQALFFREALPGSGQARFSVLLLHGIRFSSETWQNLGTLHRLAQAGYRAVAIDLPGLGHSKEAAAPAPIGELAPGSFLAAVVDALELGPPVVISPSLSGMYSLPFLTAPGSQLPGFVPVAPICTDKINAANYASVKTPALIVYGDQDPMGQTSFEHLKQLPNHRVLIMKGAGHPCYLDKPEEWHTGLLDFLQGLQ

SEQ ID NO: 6034 - protein, 415 aa, Homo sapiens
MRAADSGSWERVRQLAAQGEPAPSCGAGAGPARPPGPAACEQCVDAAGPGDRPRAGVPRVRADGDCSQPVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 6035 - protein, 230 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 6036 - protein, 848 aa, Homo sapiens
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKVNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 6037 - protein, 394 aa, Homo sapiens
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKVCSSQLYQHEAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPENVSRTRNK

SEQ ID NO: 6038 - protein, 435 aa, Homo sapiens
MAPFGRNLLKTRHKNRSPTKDMDSEEKEIVVWVCQEEKLVCGLTKRTTSADVIQALLEEHEATFGEKRFLLGKPSDYCIIEKWRGSERVLPPLTRILKLWKAWGDEQPNMQFVLVKADAFLPVPLWRTAEAKLVQNTEKLWELSPANYMKTLPPDKQKRIVRKTFRKLAKIKQDTVSHDRDNMETLVHLIISQDHTIHQQVKRMKELDLEIEKCEAKFHLDRVENDGENYVQDAYLMPSFSEVEQNLDLQYEENQTLEDLSESDGIEQLEERLKYYRILIDKLSAEIEKEVKSVCIDINEDAEGEAASELESSNLESVKCDLEKSMKAGLKIHSHLSGIQKEIKYSDSLLQMKAKEYELLAKEFNSLHISNKDGCQLKENRAKESEVPSSNGEIPPFTQRVFSNYTNDTDSDTGISSNHSQDSETTVGDVVLLST

SEQ ID NO: 6039 - protein, 547 aa, Homo sapiens
MAGTKNKTRAQAKTEKKAAIQAKAGAEREATGVVRPVAKTRAKAKAKTGSKTDAVAEMKAVSKNKVVAETKEGALSEPKTLGKAMGDFTPKAGNESTSSTCKNEAGTDAWFWAGEEATINSWFWNGEEAGNSFSTKNDKPEIGAQVCAEELEPAAGADCKPRSGAEEEEEENVIGNWFWEGDDTSFDPNPKPVSRIVKPQPVYEINEKNRPKDWSEVTIWPNAPAVTPAVLGFRSQAPSEASPPSYIVLASAEENACSLPVATACRPSRNTRSCSQPIPECRFDSDPCIQTIDEIRRQIRIREVNGIKPFACPCKMECYMDSEEFEKLVSLLKSTTDPLIHKIARIAMGVHNVHPFAQEFINEVGVVTLIESLLSFPSPEMRKKTVITLNPPSGDERQRKIELHVKHMCKETMSFPLNSPGQQSGLKILGQLTTDFVHHYIVANYFSELFHLLSSGNCKTRNLVLKLLLNMSENPTAARDMINMKALAALKLIFNQKEAKANLVSGVAIFINIKEHIRKGSIVVVDHLSYNTLMAIFREVKEIIETM

SEQ ID NO: 6040 - protein, 453 aa, Homo sapiens
MARKVVSRKRKAPASPGAGSDAQGPQFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 6041 - protein, 812 aa, Homo sapiens
MEAFQELRKPSARLECDHCSFRGTDYENVQIHMGTIHPEFCDEMDAGGLGKMIFYQKSAKLFHCHKCFFTSKMYSNVYYHITSKHASPDKWNDKPKNQLNKETDPVKSPPLPEHQKIPCNSAEPKSIPALSMETQKLGSVLSPESPKPTPLTPLEPQKPGSVVSPELQTPLPSPEPSKPASVSSPEPPKSVPVCESQKLAPVPSPEPQKPAPVSPESVKATLSNPKPQKQSHFPETLGPPSASSPESPVLAASPEPWGPSPAASPESRKSARTTSPEPRKPSPSESPEPWKPFPAVSPEPRRPAPAVSPGSWKPGPPGSPRPWKSNPSASSGPWKPAKPAPSVSPGPWKPIPSVSPGPWKPTPSVSSASWKSSSVSPSSWKSPPASPESWKSGPPELRKTAPTLSPEHWKAVPPVSPELRKPGPPLSPEIRSPAGSPELRKPSGSPDLWKLSPDQRKTSPASLDFPESQKSSRGGSPDLWKSSFFIEPQKPVFPETRKPGPSGPSESPKAASDIWKPVLSIDTEPRKPALFPEPAKTAPPASPEARKRALFPEPRKHALFPELPKSALFSESQKAVELGDELQIDAIDDQKCDILVQEELLASPKKLLEDTLFPSSKKLKKDNQESSDAELSSSEYIKTDLDAMDIKGQESSSDQEQVDVESIDFSKENKMDMTSPEQSRNVLQFTEEKEAFISEEEIAKYMKRGKGKYYCKICCCRAMKKGAVLHHLVNKHNVHSPYKCTICGKAFLLESLLKNHVAAHGQSLLKCPRCNFESNFPRGFKKHLTHCQSRHNEEANKKLMEALEPPLEEQQI

SEQ ID NO: 6042 - protein, 657 aa, Homo sapiens
MDEQEALNSIMNDLVALQMNRRHRMPGYETMKNKDTGHSNRQKKHNSSSSALLNSPTVTTSSCAGASEKKKFLSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 6043 - protein, 848 aa, Homo sapiens; identical to SEQ ID NO: 6036

SEQ ID NO: 6044 - protein, 1357 aa, Homo sapiens
MADTDLFMECEEEELEPWQKISDVIEDSVVEDYNSVDKTTTAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 6045 - protein, 967 aa, Homo sapiens
MGPGQPASTCVHLAPRTQLDGRSDPKVLQTQNQLQFNRNVPTHSSNLAIRYSCPHAIRIEKLKHSYNESYHCKDADCRVGPDLGSSVSFSVISQERLSYAVHLARRDVKRRQFEKHIKEHHLRSQPQSSQKCGHTKYKIPDHRVERKESKSQAACQCSHQPSKVEISSSGAKVYLYSSHPGQSDLTVPNSPPTHDPGLQPHPRIGDHKNISEQKSLLEVQRLQKELSSCIHKIEEVTKKDRLEEALDPDEERRIRIRRQEQAARSARMLYVLQQQVKEIQEELDKLSPHKIKHTKKSWAMSKLAAAHRGAIRALQMFVTQFTDRGEHPLPARCKELGSLIRQLSLCSVKLDADPSVPDVVIDILQQIEALESLLEKKLSPKKVKKCFSEIRSRFPIGSQKALERWPSTSPKGERRPLTAKDTFPQETSRPSVAKQLLADKYQPDTELPETQRLQSELDVLDADIVLEEGPFILDQSASFKDEVLAVAKTKAGKKKPVTENVPFRKKDTLAPARQQGLRKAERGRQSQPHSKSRVQQTTVSSRLKMNRQPVKDRKAPWIPPNPTSPPASPKCAAWLKVKTSPRDATKEPLQQEDPQEESHLTGAVEHEAARLAWLDAETSKRLKELEELKAKEIDSMQKQRLDWLDAETSRRTKELNELKAEEMYRLQQLSVSATHLADKVEEAVLDRLKPLLVKAQRVNSTTEANIHLKDGSSVNTAKAQPAQEVAAVDFESNNIRQLDDFLEDCASELWAVTHAKILGSETLATVEDSKDSPDLEIMMRRMEEMEKYQESVRQRYNKIAYADPRLWMQEENNDQKISAISEKPLSPHPIRITKTVDRKDPAVNIMLERPCNGNSLDESVGTEEGSEKREAPLLSLAEDSQQKEGRAPLFVPPGMQHSIGDYCSRFEQYLRIISHEAVGSFNPWLIAESFSEELVDEALGAVAAELQDMCEDYAEAVFTSEFLEAAT

SEQ ID NO: 6046 - protein, 2279 aa, Homo sapiens
MYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQTLDPYNRPWASKTQSEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQLKEEVKKESPTSSSFGKFSWKKPEKEEEKSSLVTPSISKEEILESSKDKEDGKTEAGKAKPIKIKLSGKTVVAHTSPWMPVVTTSTQTKIRPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGVSTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINSAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 6047 - protein, 643 aa, Homo sapiens
MGQESSKPVWPNPTGGYQSNTGRRYGRRHAYVSFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 6048 - protein, 370 aa, Homo sapiens
MPTETLQTGSMVKPVSPAGTFTSAVPLRILNKGPDYFRRQAEPNPKRLSAVERLEADKAKYVKSQEVINAKQEPVKPAVLAKPPVCPAAKRALGSPTLKVFGNHAKTESGVQRENLKLEILKNIINSSEGSSSGSGHKHSSRNWPPHRSEATDLHRHSFAESLKVYPTQGRRSPQEGGSHVGRRLLEQSAESFLHVSHSSSDIRKVTSVKPLKAIPCSSSAPPLPPKPKIAAIASMKSPEADPVEPACGVSRRPSLQRSKSDLSDRYFRVDADVERFFNYCGLDPEELENLGMENFARANSDIISLNFRSASMISSDCEQSQDSNSDLRNDDSANDRVPYGISAIERNARIIKWLYSIKQARESQKVSHV

SEQ ID NO: 6049 - protein, 1041 aa, Homo sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 6050 - protein, 51 aa, Homo sapiens [sequence omitted]

SEQ ID NO: 6051 - protein, 1208 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 6052 - protein, 331 aa, Homo sapiens
MSRQLSRARPATVLGAMEMGRRMDAPTSAAVTRAFLERGHTEIDTAFVYSEGQSETILGGLGLRLGGSDCRVKIDTKAIPLFGNSLKPDSLRFQLETSLKRLQCPRVDLFYLHMPDHSTPVEETLRACHQLHQEGKFVELGLSNYAAWEVAEICTLCKSNGWILPTVYQGMYNAITRQVETELFPCLRHFGLRFYAFNPLAGGLLTGKYKYEDKNGKQPVGRFFGNTWAEMYRNRYWKEHHFEGIALVEKALQAAYGASAPSMTSATLRWMYHHSQLQGAHGDAVILGMSSLEQLEQNLAAAEEGPLEPAVVDAFNQAWHLVTHECPNYFR

SEQ ID NO: 6053 - protein, 376 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKRESNRDGEESSSA

SEQ ID NO: 6054 - protein, 626 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 6055 - protein, 566 aa, Homo sapiens; identical to SEQ ID NO: 5875

SEQ ID NO: 6056 - protein, 151 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKDT

SEQ ID NO: 6057 - protein, 739 aa, Homo sapiens; identical to SEQ ID NO: 5973

SEQ ID NO: 6058 - protein, 563 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 6059 - protein, 174 aa, Homo sapiens
MTCCQTSFCGYPSFSISGTCGSSCCQPSCCETSCCQPRSCQTSFCGFPSFSTSGTCSSSCCQPSCCETSCCQPSCCETSCCQPSCCQISSCGTGCGIGGGISYGQEGSSGAVSTRIRWCRPDSRVEGTYLPPCCVVSCTPPSCCQLHHAQASCCRPSYCGQSCCRPVCCCEPTC

SEQ ID NO: 6060 - protein, 390 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 6061 - protein, 1201 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGLPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 6062 - protein, 431 aa, Homo sapiens
MSDQIKFIMDSLNKEPFRKNYNLITFDSLEPMQLLQVLSDVLAEIDPKQLVDIREEMPEQTAKRMLSLLGILKYKPSGNATDMSTFRQGLVIGSKPVIYPVLHWLLQRTNELKKRAYLARFLIKLEVPSEFLQDETVADTNKQYEELMEAFKTLHKEYEQLKISGFSTAEIRKDISAMEEEKDQLIKRVEHLKKRVETAQNHQWMLKIARQLRVEKEREEYLAQQKQEQKNQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDERQDLTLSPRLECGGVIMAYCSLKLLGSSDPPTSAS

SEQ ID NO: 6063 - protein, 372 aa, Homo sapiens
MASSASARTPAGKRVINQEELRRLMKEKQRLSTSRKRIESPFAKYNRLGQLSCALCNTPVKSELLWQTHVLGKQHREKVAELKGAKEASQGSSASSAPHSVKRKAPDADDQDVKRAKATLVPQVQPSTSAWTTNFDKIGKEFIRATPSKPSGLSLLPDYEDEEEEEEEEEGDGERKRGDASKPLSDAQGKEHSVSSSREVTSSVLPNDFFSTNPPKAPIIPHSGSIEKAEIHEKVVERRENTAEALPEGFFDDPEVDARVRKVDAPKDQMDKEWDEFQKAMRQVNTISEAIVAEEDEEGRLDRQIGEIDEQIECYRRVEKLRNRQDEIKNKLKEILTIKELQKKEEENADSDDEGELQDLLSQDWRVKGALL

SEQ ID NO: 6064 - protein, 593 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 6065 - protein, 349 aa, Homo sapiens
MKLTSEKLPKNPFYASVSQYAAKNQKFFQWKKEKTESDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 6066 - protein, 411 aa, Homo sapiens
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKSLLYVTFLHTFDTFSRDS

SEQ ID NO: 6067 - protein, 715 aa, Homo sapiens
MFGRKRSVSFGGFGWIDKTMLASLKVKKQELANSSDATLPDRPLSPPLTAPPTMKSSEFFEMLEKMQDDYIPYPSIDEVVEKGGPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILRSKLKTVHERIPLAGLSKLPSVPQIAKAFCDDAVGLRFNPVLYPKASQMIVSYDEHEVNNTFKFGVIYQKARQTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 6068 - protein, 756 aa, Homo sapiens
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHEVQPSVTSLF

SEQ ID NO: 6069 - protein, 783 aa, Homo sapiens
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 6070 - protein, 156 aa, Homo sapiens
MVPVFTSSALPVKDVEDKPEQQTRTRETDKSPTSTEPRQQPSALFARGNRKAVKSPQRSSSKIKENKHPFALYGWGEKQTDTGSQKTHNVCASAPVHEIHESALRAKNRRQVEKRKLVAQRQRAHSVDVEKNRKMKASSSENPWMTEYMRCYSARA

SEQ ID NO: 6071 - protein, 270 aa, Homo sapiens; identical to SEQ ID NO: 5082

SEQ ID NO: 6072 - protein, 385 aa, Homo sapiens
MAAPDLSTNLQEEATCAICLDYFTDPVMTDCGHNFCRECIRRCWGQPEGPYACPECRELSPQRNLRPNRPLAKMAEMARRLHPPSPVPQGVCPAHREPLAAFCGDELRLLCAACERSGEHWAHRVRPLQDAAEDLKAKLEKSLEHLRKQMQDALLFQAQADETCVLWQKMVESQRQNVLGEFERLRRLLAEEEQQLLQRLEEEELEVLPRLREGAAHLGQQSAHLAELIAELEGRCQLPALGLLQDIKDALRRVQDVKLQPPEVVPMELRTVCRVPGLVETLRRFRGRCGGPRWGDDSRRGPAKDLGSQPRVLCPATASSKLTVSWWWVVGKTSSAHTSDISCVGIFTPNNSSTSGNELGIQGFHSALNRIASADTTGVSTDPTD

SEQ ID NO: 6073 - protein, 416 aa, Homo sapiens
MPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGEAAKCARA

SEQ ID NO: 6074 - protein, 709 aa, Homo sapiens
MEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGEAAKCARA

SEQ ID NO: 6075 - protein, 5602 aa, Homo sapiens
MLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQDGTRCELQIRGLSVADAGEYSCVCGQERTSATLTIREATEGATAMLQCELSKVAPVEWRKGPETLRDGDRYNLRQDGTRCELQIHGLSVADTGEYSCVCGQEKTSATLTVKAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEDTTLERADQEVTSVLKRLLGPKAPGPSTGDLTGPGPCPRGAPALQETGSQPPVTGTSEAPAVPPRVPQPLLHEGPEQEPEAIARAQEWTVPIRMEGAAWPGAGTGELLWDVHSHVVRETTQRTYTYQAIDTHTARPPSMQVTIEDVQAQTGGTAQFEAIIEGDPQPSVTWYKDSVQLVDSTRLSQQQEGTTYSLVLRHVASKDAGVYTCLAQNTGGQVLCKAELLVLGGDNEPDSEKQSHRRKLHSFYEVKEEIGRGVFGFVKRVQHKGNKILCAAKFIPLRSRTRAQAYRERDILAALSHPLVTGLLDQFETRKTLILILELCSSEELLDRLYRKGVVTEAEVKVYIQQLVEGLHYLHSHGVLHLDIKPSNILMVHPAREDIKICDFGFAQNITPAELQFSQYGSPEFVSPEIIQQNPVSEASDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPPAAQGCVPRHSVIRSLFYHQAGESPEHGALAPGSRRHPARRRHLLKGGYIAGALPGLREPLMEHRVLEEEAAREEQATLLAKAPSFETALRLPASGTHLAPGHSHSLEHDSPSTPRPSSEACGEAQRLPSAPSGGAPIRDMGHPQGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMAPELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 6076 - protein, 3739 aa, Homo sapiens
MLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEVTEQETKVPKKTVIIEETITTVVKSPRGQRRSPSKSPSRSPSRCSASPLRPGLLAPDLLYLPGAGQPRRPEAEPGQKPVVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGQPVLLSVGHALGPRGPLGLFRPEPRGASPPGPQVRSLEGTSFLLREAPARPVGSAPWTQSFCTRIRRSADSGQSSFTTELSTQTVNFGTVGETVTLHICPDRDGDEAAQP

SEQ ID NO: 6077 - protein, 356 aa, Homo sapiens
MATAALLRGATPGRGGPVWRWRLRAAPRCRLAHSSCSPGGDPTAGAAWACFRLDGRTLLRVRGPDAAPFLLGLLTNELPLPSPAAAGAPPAARAGYAHFLNVQGRTLYDVILYGLQEHSEVSGFLLECDSSVQGALQKHLALYRIRRKVTVEPHPELRVWAVLPSSPEACGAASLQERAGAAAILIRDPRTARMGWRLLTQDEGPALVPGGRLGDLWDYHQHRYLQGVPEGVRDLPPGVALPLESNLAFMNGVSFTKGCYIGQELTARTHHMGVIRKRLFPVRFLDPLPTSGITPGATVLTASGQTVGKFRAGQGNVGLALLWSEKIKGPLHIRASEGAQVALAASVPDWWPTVSK

SEQ ID NO: 6078 - protein, 464 aa, Homo sapiens
MRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 6079 - protein, 222 aa, Homo sapiens
MTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 6080 - protein, 66 aa, Homo sapiens
MPQYQTWEEFSRAAEKLYLADPMKARVVLKYRHSDGNLCVKVTDDLVQWHLNYCTLRHGIAGGLET

SEQ ID NO: 6081 - protein, 82 aa, Homo sapiens
MPQYQTWEEFSRAAEKLYLADPMKARVVLKYRHSDGNLCVKVTDDLVRQCLALLLRLQCSGMIIAHCILDLLGSSGPLASAS

SEQ ID NO: 6082 - protein, 216 aa, Homo sapiens
MQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVAQTFSETSINFFPLTAAFCHVRG

SEQ ID NO: 6083 - protein, 779 aa, Homo sapiens; identical to SEQ ID NO: 5853

SEQ ID NO: 6084 - protein, 221 aa, Homo sapiens
MAAASGSVLQRCIVSPAGRHSASLIFLHGSGDSGQGLRMWIKQVLNQDLTFQHIKIIYPTAPPRFKITNDCPEHLESIDVMCQVLTDLIDEEVKSGIKKNRILIGGFSMGGCMAIHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 6085 - protein, 237 aa, Homo sapiens
MAAASGSVLQRCIVSPAGRHSASLIFLHGSGDSGQGLRMWIKQVLNQDLTFQHIKIIYPTAPPRSYTPMKGGISNVWFDRFKITNDCPEHLESIDVMCQVLTDLIDEEVKSGIKKNRILIGGFSMGGCMAIHLAYRNHQDVAGVFALSSFLNKASAVYQALQKSNGVLPELFQCHGTADELVLHSWAEETNSMLKSLGVTTKFHSFPNVYHELSKTELDILKLWILTKLPGEMEKQK

SEQ ID NO: 6086 - protein, 156 aa, Homo sapiens
METAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKGLCSH

SEQ ID NO: 6087 - protein, 311 aa, Homo sapiens
MTGSAADTHRCPHPKGAKGTRSRSSHARPVSLATSGGSEEEDKDGGVLFHVNKSGFPIDSHTWERMWMHVAKVHPKGGEMVGAIRNAAFLAKPSIPQVPNYRLSMTIPDWLQAIQNYMKTLHYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 6088 - protein, 290 aa, Homo sapiens
MWMHVAKVHPKGGEMVGAIRNAAFLAKPSIPQVPNYRLSMTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 6089 - protein, 251 aa, Homo sapiens
MTIPDWLQAIQNYMKTLQYNHTGTQFFEIRKMRPLSGLMETAKEMTRESLPIKCLEAVILGIYLTNGQPSIERFPISFKTYFSGNYFHHVVLGIYCNGRYGSLGMSRRAELMDKPLTFRTLSDLIFDFEDSYKKYLHTVKKVKIGLYVPHEPHSFQPIEWKQLVLNVSKMLRADIRKELEKYARDMRMKILKPASAHSPTQVRSRGKSLSPRRRQASPPRRLGRREKSPALPEKKVADLSTLNEVGYQIRI

SEQ ID NO: 6090 - protein, 290 aa, Homo sapiens; identical to SEQ ID NO: 6088

SEQ ID NO: 6091 - protein, 240 aa, Homo sapiens
MAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILSLPALIEQGEGFSQVLRMQPVIHLQRIHQEVFSSCHRKPDAKPENFITQIETTPTETASRKTSDMVLKRKQTKDCPQRKWYPLRPKKINLDT

SEQ ID NO: 6092 - protein, 172 aa, Homo sapiens
MAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVLACIN

SEQ ID NO: 6093 - protein, 281 aa, Homo sapiens
MAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPAPHMENLKCRGETVAKEISEAMKSLPALIEQGEGFSQVLRMQPVIHLQRIHQEVFSSCHRKPDAKPENFITQIETTPTETASRKTSDMVLKRKQTKDCPQRKWYPLRPKKINLDT

SEQ ID NO: 6094 - protein, 75 aa, Homo sapiens
MDSDIKVLEDQFDEIIVDIATKRKQYPRKILECVIKTIKAKQEILKQYHPVVHPLDLKYDPDPGAKPGGLALGAV

SEQ ID NO: 6095 - protein, 92 aa, Homo sapiens
MEDYQAAEETAFVVDEVSNIVKEAIESAIGGNAYQHSKVNQWTTNVVEQTLSQLTKLGKPFKYIGNGVLFLLYLRDGFLTLIRGASSTRNNS

SEQ ID NO: 6096 - protein, 67 aa, Homo sapiens [sequence omitted]

SEQ ID NO: 6097 - protein, 113 aa, Homo sapiens
MEDYQAAEETAFVVDEVSNIVKEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 6098 - protein, 678 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPGDAVWTD

SEQ ID NO: 6099 - protein, 1543 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPVTGASGVPENSPPCTVNIPIAPIHSSAQAMSPTQSIGLVQSLLANQNVQLDVLTNQTTAVGTAEHAGDSATQYPVSNRYSNPGQVIFGSVEMGRIIQNPPPLSLPPPPQGPMQLSTVGHGDRDHEHLQKSAKALRPTPQLAAEGDAVVFSAPQEVQVTKINPPPPYPGTIPAAPTTAAPPPPLPPPQPPVDVCLKKGDFSLYPTSVHYQTPLGYERITTFDSSGNVEEVCRPRTRMLCSQNTYTLPGPGSSATLRLTATEKKVPQPCSSATLNRLTVPRYSIPTGDPPPYPEIASQLAQGRGAAQRSDNSLIHATLRRNNREATLKMAQLADSPRAPLQPLAKSKGGPGGVVTQLPARPPPALYTCSQCSGTGPSSQPGASLAHTASASPLASQSSYSLLSPPDSARDRTDYVNSAFTEDEALSQHCQLEKPLRHPPLPEAAVTLKRPPPYQWDPMLGEDVWVPQERTAQTSGPNPLKLSSLMLSQGQHLDVSRLPFISPKSPASPTATFQTGYGMGVPYPGSYNNPPLPGVQAPCSPKDALSPTQFAQQEPAVVLQPLYPPSLSYCTLPPMYPGSSTCSSLQLPPVALHPWSSYSACPPMQNPQGTLPPKPHLVVEKPLVSPPPADLQSHLGTEVMVETADNFQEVLSLTESPVPQRTEKFGKKNRKRLDSRAEEGSVQAITEGKVKKEARTLSDFNSLISSPHLGREKKKVKSQKDQLKSKKLNKTNEFQDSSESEPELFISGDELMNQSQGSRKGWKSKRSPRAAGELEEAKCRRASEKEDGRLGSQGFVYVMANKQPLWNEATQVYQLDFGGRVTQESAKNFQIELEGRQVMQFGRIDGSAYILDFQYPFSAVQAFAVALANVTQRLK

SEQ ID NO: 6100 - protein, 1077 aa, Homo sapiens
MDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANDFSNVPDITTGLKRSQTDGTLDQVSHREKMEQTFRSAEQITALCRSFNDSQANGMEGPRENQDPPPRSLARHLSDADRLRKVIQELVDTEKSYVKDLSCLFELYLEPLQNETFLTQDEMESLFGSLPEMLEFQKVFLETLEDGISASSDFNTLETPSQFRKLLFSLGGSFLYYADHFKLYSGFCANHIKVQKVLERAKTDKAFKAFLDARNPTKQHSSTLESYLIKPVQRVLKYPLLLKELVSLTDQESEEHYHLTEALKAMEKVASHINEMQKIYEDYGTVFDQLVAEQSGTEKEVTELSMGELLMHSTVSWLNPFLSLGKARKDLELTVFVFKRAVILVYKENCKLKKKLPSNSRPAHNSTDLDPFKFRWLIPISALQVRLGNPAGTENNSIWELIHTKSEIEGRPETIFQLCCSDSESKTNIVKVIRSILRENFRRHIKCELPLEKTCKDRLVPLKNRVPVSAKLASSRSLKVLKNSSSNEWTGETGKGTLLDSDEGSLSSGTQSSGCPTAEGRQDSKSTSPGKYPHPGLADFADNLIKESDILSDEDDDHRQTVKQGSPTKDIEIQFQRLRISEDPDVHPEAEQQPGPESGEGQKGGEQPKLVRGHFCPIKRKANSTKRDRGTLLKAQIRHQSLDSQSENATIDLNSVLEREFSVQSLTSVVSEECFYETESHGKS

SEQ ID NO: 6101 - protein, 192 aa, Homo sapiens
MSQCACLEEVHLPNIKPGEGLGMYIKSTYDGLHVITGTTENVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPT

SEQ ID NO: 6102 - protein, 555 aa, Homo sapiens
MEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 6103 - protein, 235 aa, Homo sapiens
MRSRVLWGAARWLWPRRAVGPARRPLSSGSPPLEELFTRGGPLRTFLERQAGSEAHLKVRRPELLAVIKLLNEKERELRETEHLLHDENEDLRKLAENEITLCQKEITQLKHQIILLLVPSEETDENDLILEVTAGVGGGLRHASASIGGSEAYRHMKFEGGVHRVQRVPKTEKQGRVHTSTMTVAILPQPTEINLVINPKDLRIDTKRASGAGGQHVNTTDSAVRIVHLPTDWK

SEQ ID NO: 6104 - protein, 271 aa, Homo sapiens
MRSRVLWGAARWLWPRRAVGPARRPLSSGSPPLEELFTRGGPLRTFLERQAGSEAHLKVRRPELLAVIKLLNEKERELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTDWK

SEQ ID NO: 6105 - protein, 380 aa, Homo sapiens
MRSRVLWGAARWLWPRRAVGPARRPLSSGSPPLEELFTRGGPLRTFLERQAGSEAHLKVRRPELLAVIKLLNEKERELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 6106 - protein, 1186 aa, Homo sapiens
MCEVMPTINEGDRLGPPHGADADANFEQLMVNMLDEREKLLESLRESQETLAATQSRLQDAIHERDQLQRHLNSALPQEFATLTRELSMCREQLLEREEEISELKAERNNTRLLLEHLECLVSRHERSLRMTVVKRQAQSPSGVSSEVEVLKALKSLFEHHKALDEKVRERLRAALERVTTLEEQLAGAHQQVSALQQGAGVRDGAAEEEGTVELGPKRLWKEDTGRVEELQELLEKQNFELSQARERLVTLTTTVTELEEDLGTARRDLIKSEELSSKHQRDLREALAQKEDMEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARVRQREKMNEDHNKRLSDTVDRLLSESNERLQLHLKERMAALEEKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 6107 - protein, 600 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKVEVPKLLQ

SEQ ID NO: 6108 - protein, 275 aa, Homo sapiens
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKTESRSVTRLECRRVI

SEQ ID NO: 6109 - protein, 332 aa, Homo sapiens
  MOD_RES (1)..(1): Any amino acid
XGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTP

SEQ ID NO: 6110 - protein, 978 aa, Homo sapiens
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 6111 - protein, 135 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQHLLYFCLHSTSTSSLL

SEQ ID NO: 6112 - protein, 642 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 6113 - protein, 135 aa, Homo sapiens
MSKNTVSSARFRKVDVDEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFESPSDNSSAMLLQWHEKVPLV

SEQ ID NO: 6114 - protein, 282 aa, Homo sapiens
MASSFLPAGAITGDSGGELSSGDDSGEVEFPHSPEIEETSCLAELFEKAAAHLQGLIQVASREQLLYLYARYKQVKVGNCNTPKPSFFDFEGKQKWEAWKALGDSSPSQAMQEYIAVVKKLDPGWNPQIPEKKGKEANTGFGGPVISSLYHEETIREEDKNIFDYCRENNIDHITKAIKSKNVDVNVKDEEGRALLHWACDRGHKELVTVLLQHRADINCQDNEGQTALHYASACEFLDIVELLLQSGADPTLRDQDGCLPEEVTGCKTVSLVLQRHTTGKA

SEQ ID NO: 6115 - protein, 3117 aa, Homo sapiens
MRSSKSKEVPLPNPRNSQSKDTVQADITTSWDALSQTKAALRHIENKLEVAPTSTAVCDSVMDTKKSSTSATRKISRKDGRYLDDSWVNAPISKSTKSRKEKSRSPLRATTLESNVKKNNRVEFREPLVSYREIHGAPSNFSSSHLESKHVYCVDVNEEKTESGNWMIGSREERNIRSCDFESSQSSVINDTVVRFLNDRPAIDALQNSECLIRMGASMRTEEEMPNRTKGSENNLKLSVNNMAHDTDPKALRLTDSSPSSTSTSNSQRLDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRERTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPEGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLESIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 6116 - protein, 981 aa, Homo sapiens; identical to SEQ ID NO: 5143

SEQ ID NO: 6117 - protein, 215 aa, Homo sapiens
MSAKRAELKKTHLVKERHCWTSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRGIYAAVGLLDLW

SEQ ID NO: 6118 - protein, 201 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCVSETLPEPSTGARPLAPAPW

SEQ ID NO: 6119 - protein, 99 aa, Homo sapiens
MSAKRAELKKTHLSKNYKAVCLELKPEPTKVRSPFEAMQAARPEIHGEVTRSQGSFADPSGQDLSQTFDYKAVKQEGRFTKAGRTPRLLEELSLLLLPL

SEQ ID NO: 6120 - protein, 212 aa, Homo sapiens
MSAKRAELKKTHLSKNYKAVCLELKPEPTKTFDYKAVKQEGRFTKAGVTQDLKNELREVREELKEKMEEIKQIKDLMDKDFDKLHEFVEIMKEMQKDMDEKMDILINTQKNYKLPLRRAPKEQQELRLMGKTHREPQLRPKKMDGASGVNGAPCALHKKTMAPQKTKQGSLDPLHHCGTCCEKCLLCALKNNYNRAQLQNLPAVPIHHLQAP

SEQ ID NO: 6121 - protein, 133 aa, Homo sapiens
  MOD_RES (1)..(1): Any amino acid
XYELREEHLDKIFKHRELQQKLVDAKLEQAQEMMKEAEERHKREKEYLLNQAAEWKLQAKVLKEQETVLQAQVRPGGRGMGVLSSLSPDKKAGAKGGQQKSSYVAGDGGMGIGNEEQLHIYSYFQVKIKAQYY

SEQ ID NO: 6122 - protein, 228 aa, Homo sapiens
MASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 6123 - protein, 185 aa, Homo sapiens
MQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 6124 - protein, 377 aa, Homo sapiens
MEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 6125 - protein, 253 aa, Homo sapiens
MIENSSWSMTFEERENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 6126 - protein, 252 aa, Homo sapiens
MGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKVCWSLLEVHSRPCLPGYHQWKLQNSKYCRMANVAA

SEQ ID NO: 6127 - protein, 827 aa, Homo sapiens
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKFFFL

SEQ ID NO: 6128 - protein, 859 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 6129 - protein, 586 aa, Homo sapiens
SESLSSAVFVEGLKRQGGCARLEEACLSEAGEDLTGVRFSLPGKNFPCGSSSSSSRSRNSSSSNSSSSSSTTTTTTSSSGAQDRMPVLERYFHPAELGRRWTGPEGVLPSSPGSRPGCQQGPLPWDLPEMIRMVKLVWKSKSELQATKQRGILDNEDALRSFPGDIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNGNSLVTLLCHLFNTHGLIHHFKLDMVTLHRFLVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 6130 - protein, 174 aa, Homo sapiens
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVRRALIDKMSTTLYVWTF

SEQ ID NO: 6131 - protein, 400 aa, Homo sapiens; identical to SEQ ID NO: 5527

SEQ ID NO: 6132 - protein, 91 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKL

SEQ ID NO: 6133 - protein, 163 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGIL

SEQ ID NO: 6134 - protein, 340 aa, Homo sapiens
MLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPFEKAYEKLQILKPEAKMNEGFEWQLKLYQAMGYEVDTSSAIYKQYRLQKVTEKYPELQNLPQELFAVDPTTVSQGLKDEVLYKCRKCRRSLFRSSSILDHREGSGPIAFAHKRMTPSSMLTTGRQAQCTSYFIEPVQWMESALLGVMDGQLLCPKCSAKLGSFNWYGEQCSCGRWITPAFQIHKNRVDEMKILPVLGSQTGKI

SEQ ID NO: 6135 - protein, 268 aa, Homo sapiens
MWPLTALLLLATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 6136 - protein, 311 aa, Homo sapiens
MWPLTALLLLATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQAARCAASTGAPSTQSRSPRSRSSNRTGARRLPPPAVSGNAVRGCSSRGRVLPWTRPPPPPQLHGPQPWLLVIGRFPSESPRCPDRSRWSPPSGTPPPPGCSSRRAAPRLRGHPPALRRRPWNNRLEP

SEQ ID NO: 6137 - protein, 318 aa, Homo sapiens
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQAARCAASTGAPSTQSRSPRSRSSNRTGARRLPPPAVSGNAVRGCSSRGRVLPWTRPPPPPQLHGPQPWLLVIGRFPSESPRCPDRSRWSPPSGTPPPPGCSSRRAAPRLRGHPPALRRRPWNNRLEP

SEQ ID NO: 6138 - protein, 426 aa, Homo sapiens
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 6139 - protein, 122 aa, Homo sapiens
MAGGCRAPSSAPTVSLPELRSLLASGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 6140 - protein, 74 aa, Homo sapiens
MAGVSELESALQMEPAAFQALYSAEKPKLEDEHLVFFCQMGKRGLQATQLARSLGYTGARNYAGAYREWLEKES

SEQ ID NO: 6141 - protein, 597 aa, Homo sapiens; identical to SEQ ID NO: 5494

SEQ ID NO: 6142 - protein, 597 aa, Homo sapiens; identical to SEQ ID NO: 5494

SEQ ID NO: 6143 - protein, 150 aa, Homo sapiens
MGVQPPNFSWVLPGRLAGLALPRLPAHYQFLLDLGVRHLVSLTERGPPHSDSCPGLTLHRLRIPDFCPPAPDQIDRFVQIVDEANARGEAVGVHCALGFGRTGTMLACYLVKERGLAAGDAIAEIRRLRPGSIETYEQEKAVFQFYQRTK

SEQ ID NO: 6144 - protein, 150 aa, Homo sapiens; identical to SEQ ID NO: 6143

SEQ ID NO: 6145 - protein, 150 aa, Homo sapiens; identical to SEQ ID NO: 6143

SEQ ID NO: 6146 - protein, 1621 aa, Homo sapiens
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 6147 - protein, 125 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 6148 - protein, 125 aa, Homo sapiens; identical to SEQ ID NO: 6147

SEQ ID NO: 6149 - protein, 125 aa, Homo sapiens; identical to SEQ ID NO: 6147

SEQ ID NO: 6150 - protein, 125 aa, Homo sapiens; identical to SEQ ID NO: 6147

SEQ ID NO: 6151 - protein, 125 aa, Homo sapiens; identical to SEQ ID NO: 6147

SEQ ID NO: 6152 - protein, 207 aa, Homo sapiens
MAEASSANLGSGCEEKRHEGSSSESVPPGTTISRVKLLDTMVDTFLQKLVAAGSSPLLHWDGSAGPRLPSGGQSVKQAFSWAACRLPQGRKEEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 6153 - protein, 205 aa, Homo sapiens
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPYFLQQRDTLRRHVQKQEAENQQLADAVLAGRRQVEELQLQVQAQQQAWQALHREQRELVAVLREPE

SEQ ID NO: 6154 - protein, 180 aa, Homo sapiens
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPACNGTPCGAMCRNRRPRTSSWQMPSWQGGGRWRSCSYRSRPSSRPGRLYTENRGSWLLC

SEQ ID NO: 6155 - protein, 750 aa, Homo sapiens; identical to SEQ ID NO: 5802

SEQ ID NO: 6156 - protein, 888 aa, Homo sapiens
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 6157 - protein, 868 aa, Homo sapiens
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 6158 - protein, 524 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPAVESIPVFGALCSSSSLHQTLEALARDLTKLDLRRWASFMDAGVEHDDVAELLQELQSLAQCYQGGDSLVD

SEQ ID NO: 6159 - protein, 492 aa, Homo sapiens
MPPTCSPGLRRQDWAPGRCAGLHLPPRAPSSPALQALAGQAGVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 6160 - protein, 433 aa, Homo sapiens; identical to SEQ ID NO: 5130

SEQ ID NO: 6161 - protein, 902 aa, Homo sapiens
MLSPQRALLCNLNHIHLQHVSLGLHLSRRPELQEGPLSTPPPPGDTGGKESRGPCSGTLVDANSNSPAVPCRCCQEHGPGLENRQDPSQEEEGAASPSDPGCSSSLSSCSDLSPDESPVSVYLRDLPGDEDAHPQPSIIPLEQGSPLASAGPGTCSPDSFCCSPDSCSGASSSPDPGLDSNCNALTTCQDVPSPGLEEEDERAEQDLPTSELLEADDGKIDAGKTEPSWKINPIWKIDTEKTKAEWKTTENNNTGWKNNGNVNSSWKSEPEKFDSGWKTNTRITDSGSKTDAGKIDGGWRSDVSEEPVPHRTITSFHELAQKRKRGPGLPLVPQAKKDRSDWLIVFSPDTELPPSGSPGGSSAPPREVTTFKELRSRSRAPAPPVPPRDPPVGWALVPPRPPPPPVPPRRKKNRPGLQPIAEGQSEEGRAVSPAAGEEAPAAKEPGAQAGLEVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGLLSLLYLPTGFFSLARGGCPSLSTELLLLLQPLSVLTFHLDLLFEHHHHLPLGPPQAPAPPGPPPALQQTMQAMLHFGGRLAQSLRGTSKEAASDPSDSPNLPTPGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 6162 - protein, 796 aa, Homo sapiens
MLSPQRALLCNLNHIHLQHVSLGLHLSRRPELQEGPLSTPPPPGDTGGKESRGPCSGTLVDANSNSPAVPCRCCQEHGPGLENRQDPSQEEEGAASPSDPGCSSSLSSCSDLSPDESPVSVYLRDLPGDEDAHPQPSIIPLEQGSPLASAGPGTCSPDSFCCSPDSCSGASSSPDPGLDSNCNALTTCQDVPSPGLEEEDERAEQDLPTSELLEADDGKIDAGKTEPSWKINPIWKIDTEKTKAEWKTTENNNTGWKNNGNVNSSWKSEPEKFDSGWKTNTRITDSGSKTDAGKIDGGWRSDVSEEPVPHRTITSFHELAQKRKRGPGLPLVPQAKKDRSDWLIVFSPDTELPPSGSPGGSSAPPREVTTFKELRSRSRAPAPPVPPRDPPVGWALVPPRPPPPPVPPRRKKNRPGLQPIAEGQSEEGRAVSPAAGEEAPAAKEPGAQAGLEVRSSWSFAGVPGAQRLWMAEAQSGTGQLQEQKKGLLIAVSVSVDKIISHFGAARNLVQKAQLGDSRLSPDVGHLVLTTLCPALHALVADGLKPFRKDLITGQRRSSPWSVVEASVKPGSSTRSLGTLYSQVSRLAPLSSSRSRFHAFILGLLNTKQLELWFSSLQEDAGSWWEQLTQASRVYASGGTEGFPLSRWAPGRHGTAAEEGAQERPLPTDEMAPGRGLWLGRLFGVPGGPAENENGALKSRRPSSWLPPTVSVLALVKRGAPPEMPSPQELEASAPRMVQTHRAVRALCDHTAARPDQLSFRRGEVLRVITTVDEDWLRCGRDGMEGLVPVGYTSLVL

SEQ ID NO: 6163 - protein, 170 aa, Homo sapiens
MASVSSATFSGHGARSLLQFLRLVGQLKRVPRTGWVYRNVQRPESVSDHMYRMAVMAMVIKDDRLNKDREAMKQITQLLPEDLRKELYELWEEYETQSSAEAKFVKQLDQCEMILQASEYEDLEHKPGRLQDFYDSTAGKFNHPEIVQLVSELEAERSTNIAAAASEPHS

SEQ ID NO: 6164 - protein, 131 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 6165 - protein, 144 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRRK

SEQ ID NO: 6166 - protein, 315 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGGLSESETGPMEEVERQVLPDPEVLEAVGDRQDGLREQLQAPVPPDSVPSLQNMGLLLDKLAKENQDIRLLQAQLQVGTGRRGWARVTHLGQASVLASSPKRNVSYLPTHPDPPLSHYSQGVFPVLGSHPLC

SEQ ID NO: 6167 - protein, 731 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 6168 - protein, 702 aa, Homo sapiens
MDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 6169 - protein, 808 aa, Homo sapiens
MIWRNNWKSTTGRLNVKLQSDKLQHGCGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEPDQSRQQTVLSKRPLFDLTVIDQLFKEMSCCLFDLKALCSILNQRAQGKEPNLSLLLGIRSMNCSAEETENDHSTETLTKKLSDVCQLRRDIDELRTTISDRYAQDMGDNCITQ

SEQ ID NO: 6170 - protein, 805 aa, Homo sapiens
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKLKTRDRYISSLKKKCQKESEQNKEKQRRIETLEKYLADLPTLDDVQSQSLQLQILEEKNKNLQEALIDTEKKLEEIKKQCQDKETQLICQKKKEKELVTTVQSLQQKVERCLEDGIRLPMLDAKQLQNENDNLRQQNETASKIIDSQQDEIDRMILEIQSMQGKLSKEKLTTQKMMEELEKKERNVQRLTKALLENQRQTDETCSLLDQGQEPDQSRQQTVLSKRPLFDLTVIDQLFKEMSCCLFDLKALCSILNQRAQGKEPNLSLLLGIRSMNCSAEETENDHSTETLTKKLSDVCQLRRDIDELRTTISDRYAQDMGDNCITQ

SEQ ID NO: 6171 - protein, 495 aa, Homo sapiens
MVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 6172 - protein, 902 aa, Homo sapiens; identical to SEQ ID NO: 4825

SEQ ID NO: 6173 - protein, 539 aa, Homo sapiens; identical to SEQ ID NO: 5897

SEQ ID NO: 6174 - protein, 150 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTCECACFWSWEQNIALGLGV

SEQ ID NO: 6175 - protein, 115 aa, Homo sapiens
MAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSE

SEQ ID NO: 6176 - protein, 103 aa, Homo sapiens
MSDCYTELEKAVIVLVENFYKYVSKYSLVKNKISKSSFREMLQKELNHMLSDTGNRKAADKLIQNLDANHDGRISFDEYWTLIGGITGPIAKLIHEQEQQSSS

SEQ ID NO: 6177 - protein, 103 aa, Homo sapiens; identical to SEQ ID NO: 6176

SEQ ID NO: 6178 - protein, 103 aa, Homo sapiens; identical to SEQ ID NO: 6176

SEQ ID NO: 6179 - protein, 103 aa, Homo sapiens; identical to SEQ ID NO: 6176

SEQ ID NO: 6180 - protein, 101 aa, Homo sapiens; identical to SEQ ID NO: 5525

SEQ ID NO: 6181 - protein, 101 aa, Homo sapiens; identical to SEQ ID NO: 5525

SEQ ID NO: 6182 - protein, 73 aa, Homo sapiens
MSYQQQQCKQPCQPPPVCPTPKCPEPCPPPKCPEPYLPPPCPPEHCPPPPCQDKCPPVQPYPPCQQKYPPKSK

SEQ ID NO: 6183 - protein, 72 aa, Homo sapiens
MSYQQQQCKQPCQPPPVCPTPKCPEPCPPPKCPEPCPPPKCPQPCPPQQCQQKCPPVTPSPPCQPKCPPKSK

SEQ ID NO: 6184 - protein, 72 aa, Homo sapiens; identical to SEQ ID NO: 6183

SEQ ID NO: 6185 - protein, 72 aa, Homo sapiens; identical to SEQ ID NO: 6006

SEQ ID NO: 6186 - protein, 72 aa, Homo sapiens; identical to SEQ ID NO: 6006

SEQ ID NO: 6187 - protein, 72 aa, Homo sapiens; identical to SEQ ID NO: 6006

SEQ ID NO: 6188 - protein, 2850 aa, Homo sapiens
MPKLLQGVITVIDVFYQYATQHGEYDTLNKAELKELLENEFHQILKNPNDPDTVDIILQSLDRDHNKKVDFTEYLLMIFKLVQARNKIIGKDYCQVSGSKLRDDTHQHQEEQEETEKEENKRQESSFSHSSWSAGENDSYSRNVRGSLKPGTESISRRLSFQRDFSGQHNSYSGQSSSYGEQNSDSHQSSGRGQCGSGSGQSPNYGQHGSGSGQSSSNDTHGSGSGQSSGFSQHKSSSGQSSGYSQHGSGSGHSSGYGQHGSRSGQSSRGERHRSSSGSSSSYGQHGSGSRQSLGHGRQGSGSRQSPSHVRHGSGSGHSSSHGQHGSGSSYSYSRGHYESGSGQTSGFGQHESGSGQSSGYSKHGSGSGHSSSQGQHGSTSGQASSSGQHGSSSRQSSSYGQHESASRHSSGRGQHSSGSGQSPGHGQRGSGSGQSPSSGQHGTGFGRSSSSGPYVSGSGYSSGFGHHESSSEHSSGYTQHGSGSGHSSGHGQHGSRSGQSSRGERQGSSAGSSSSYGQHGSGSRQSLGHSRHGSGSGQSPSPSRGRHESGSRQSSSYGPHGYGSGRSSSRGPYESGSGHSSGLGHQESRSGQSSGYGQHGSSSGHSSTHGQHGSTSGQSSSCGQHGATSGQSSSHGQHGSGSSQSSRYGQQGSGSGQSPSRGRHGSDFGHSSSYGQHGSGSGWSSSNGPHGSVSGQSSGFGHKSGSGQSSGYSQHGSGSSHSSGYRKHGSRSGQSSRSEQHGSSSGLSSSYGQHGSGSHQSSGHGRQGSGSGHSPSRVRHGSSSGHSSSHGQHGSGTSCSSSCGHYESGSGQASGFGQHESGSGQGYSQHGSASGHFSSQGRHGSTSGQSSSSGQHDSSSGQSSSYGQHESASHHASGRGRHGSGSGQSPGHGQRGSGSGQSPSYGRHGSGSGRSSSSGRHGSGSGQSSGFGHKSSSGQSSGYTQHGSGSGHSSSYEQHGSRSGQSSRSEQHGSSSGSSSSYGQHGSGSRQSLGHGQHGSGSGQSPSPSRGRHGSGSGQSSSYGPYRSGSGWSSSRGPYESGSGHSSGLGHRESRSGQSSGYGQHGSSSGHSSTHGQHGSTSGQSSSCGQHGASSGQSSSHGQHGSGSSQSSGYGRQGSGSGQSPGHGQRGSGSRQSPSYGRHGSGSGRSSSSGQHGSGLGESSGFGHHESSSGQSSSYSQHGSGSGHSSGYGQHGSRSGQSSRGERHGSSSGSSSHYGQHGSGSRQSSGHGRQGSGSGHSPSRGRHGSGLGHSSSHGQHGSGSGRSSSRGPYESRSGHSSVFGQHESGSGHSSAYSQHGSGSGHFCSQGQHGSTSGQSSTFDQEGSSTGQSSSYGHRGSGSSQSSGYGRHGAGSGQSPSRGRHGSGSGHSSSYGQHGSGSGWSSSSGRHGSGSGQSSGFGHHESSSWQSSGCTQHGSGSGHSSSYEQHGSRSGQSSRGERHGSSSGSSSSYGQHGSGSRQSLGHGQHGSGSGQSPSPSRGRHGSGSGQSSSYSPYGSGSGWSSSRGPYESGSSHSSGLGHRESRSGQSSGYGQHGSSSGHSSTHGQHGSTSGQSSSCGQHGASSGQSSSHGQHGSGSSQSSGYGRQGSGSGQSPGHGQRGSGSRQSPSYGRHGSGSGRSSSSGQHGSGLGESSGFGHHESSSGQSSSYSQHGSGSGHSSGYGQHGSRSGQSSRGERHGSSSRSSSRYGQHGSGSRQSSGHGRQGSGSGQSPSRGRHGSGLGHSSSHGQHGSGSGRSSSRGPYESRSGHSSVFGQHESGSGHSSAYSQHGSGSGHFCSQGQHGSTSGQSSTFDQEGSSTGQSSSHGQHGSGSSQSSSYGQQGSGSGQSPSRGRHGSGSGHSSSYGQHGSGSGWSSSSGRHGSGSGQSSGFGHHESSSWQSSGYTQHGSGSGHSSSYEQHGSRSGQSSRGEQHGSSSGSSSSYGQHGSGSRQSLGHGQHGSGSGQSPSPSRGRHGSGSGQSSSYGPYGSGSGWSSSRGPYESGSGHSSGLGHRESRSGQSSGYGQHGSSSGHSSTHGQHGSASGQSSSCGQHGASSGQSSSHGQHGSGSSQSSGYGRQGSGSGQSPGHGQRGSGSRQSPSYGRHGSGSGRSSSSGQHGPGLGESSGFGHHESSSGQSSSYSQHGSGSGHSSGYGQHGSRSGQSSRGERHGSSSGSSSRYGQHGSGSRQSSGHGRQGSGSGHSPSRGRHGSGSGHSSSHGQHGSGSGRSSSRGPYESRSGHSSVFGQHESGSGHSSAYSQHGSGSGHFCSQGQHGSTSGQSSTFDQEGSSTGQSSSHGQHGSGSSQSSSYGQQGSGSGQSPSRGRHGSGSGHSSSYGQHGSGSGWSSSSGRHGSGSGQSSGFGHHESSSWQSSGYTQHGSGSGHSSSYEQHGSRSGQSSRGERHGSSSGSSSSYGQHGSGSRQSLGHGQHGSGSGQSPSPSRGRHGSGSGQSSSYSPYGSGSGWSSSRGPYESGSGHSSGLGHRESRSGQSSGYGQHGSSSGHSSTHGQHGSTSGQSSSCGQHGASSGQSSSHGQHGSGSSQSSGYGRQGSGSGQSPGHGQRGSGSRQSPSYGRHGSGSGRSSSSGQHGSGLGESSGFGHHESSSGQSSSYSQHGSGSGHSSGYGQHGSRSGQSSRGERHGSSSGSSSHYGQHGSGSRQSSGHGRQGSGSGQSPSRGRHGSGLGHSSSHGQHGSGSGRSSSRGPYESRLGHSSVFGQHESGSGHSSAYSQHGSGSGHFCSQGQHGSTSGQSSTFDQEGSSTGQSSSYGHRGSGSSQSSGYGRHGAGSGQSLSHGRHGSGSGQSSSYGQHGSGSGQSSGYSQHGSGSGQDGYSYCKGGSNHDGGSSGSYFLSFPSSTSPYEYVQEQRCYFYQ

SEQ ID NO: 6189 - protein, 291 aa, Homo sapiens
MSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGWSTVAGFWLTAALTSWAQAIFSTSASRVGGTTGTHHHAWIIFVFLAETRFCHVVQAGLELLGSSDSPTWPPKVLGLYHARPSLAF

SEQ ID NO: 6190 - protein, 210 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKEQGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAQ

SEQ ID NO: 6191 - protein, 270 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKEQGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQAVMIGDDIVGDVGGAQRCGMRALQVRTGKFRPSDEHHPEVKADGYVDNLAEAVDLLLQHADK

SEQ ID NO: 6192 - protein, 1315 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 6193 - protein, 801 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 6194 - protein, 816 aa, Homo sapiens
MGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEELSSSTESIDNSFSSPVRLAPEREFIKSLMAIGKRLATLPTKEQKTQRLISELSLLNHKLPARVWLPTAGFDHHVVRVPHTQAVVLNSKDKAPYLIYVEVLECENFDTTSVPARIPENRIRSTRSVENLPECGITHEQRAGSFSTVPNYDNDDEAWSVDDIGELQVELPEVHTNSCDNISQFSVDSITSQESKEPVFIAAGDIRRRLSEQLAHTPTAFKRDPEDPSAVALKEPWQEKVRRIREGSPYGHLPNWRLLSVIVKCGDDLRQELLAFQVLKQLQSIWEQERVPLWIKPYKILVISADSGMIEPVVNAVSIHQVKKQSQLSLLDYFLQEHGSYTTEAFLSAQRNFVQSCAGYCLVCYLLQVKDRHNGNILLDAEGHIIHIDFGFILSSSPRNLGFETSAFKLTTEFVDVMGGLDGDMFNYYKMLMLQGLIAARKHMDKVVQIVEIMQQGSQLPCFHGSSTIRNLKERFHMSMTEEQLQLLVEQMVDGSMRSITTKLYDGFQYLTNGIM

SEQ ID NO: 6195 - protein, 801 aa, Homo sapiens; identical to SEQ ID NO: 6193

SEQ ID NO: 6196 - protein, 828 aa, Homo sapiens; identical to SEQ ID NO: 5011

SEQ ID NO: 6197 - protein, 380 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEGERDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 6198 - protein, 377 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 6199 - protein, 310 aa, Homo sapiens
MRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 6200 - protein, 369 aa, Homo sapiens
MRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGWQIFQSTPTEEVPFWADVVLGFRKMTEAELKKFPQYVFGQAFTTLKCECPAYLPWLEKRIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 6201 - protein, 341 aa, Homo sapiens
MDTARIAVVGAGVVGLSTAVCISKLVPRCSVTIISDKFTPDTTSDVAAGMLIPHTYPDTPIHTQKQWFRETFNHLFAIANSAEAGDAGVHLVSGWQIFQSTPTEEVPFWADVVLGFRKMTEAELKKFPQYVFGQAFTTLKCECPAYLPWLEKRIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 6202 - protein, 357 aa, Homo sapiens
MGTIQEAGKKTDVGVREIAEAPELGAALRHGELELKEEWQDEEFPRLLPEEAGTSEDPEDPKGDSQAAAGTPSTLALCGQRPMRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 6203 - protein, 422 aa, Homo sapiens
MLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6204 - protein, 518 aa, Homo sapiens
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6205 - protein, 1000 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENKEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 6206 - protein, 164 aa, Homo sapiens
MVNSVVFFDITVDGKPLGRISIKLFADKILKTAENFRALSTGEKGFRYKGSCFHRIIPGFMCQGGDFTRHNGTGDKSIYGEKFDDENLIRKHTGSGILSMANAGPNTNGSQFFICAAKTEWLDGKHVAFGKVKERVNIVEAMEHFGYRNSKTSKKITIADCGQF

SEQ ID NO: 6207 - protein, 141 aa, Homo sapiens
MKILDVGCGGGLLTEPGGSLFITTINKTQLSYALGIVFSEQIASIVPKGTHTWEKFVSPETLESILESNGLSVQTVVGMLYNPFSGYWHWSENTSLNYAAYAVKSRVQEHPASAEFVLKGETEELQANACTNPAVHEKLKK

SEQ ID NO: 6208 - protein, 141 aa, Homo sapiens; identical to SEQ ID NO: 6207

SEQ ID NO: 6209 - protein, 718 aa, Homo sapiens
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6210 - protein, 530 aa, Homo sapiens
MFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPELLSPGVQRLSYLRTSSLSPTHSDSRPNPPFRHHFIPHIKGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6211 - protein, 702 aa, Homo sapiens
MVKEKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6212 - protein, 401 aa, Homo sapiens
MFTEGEEMYLQGSTVWHPDCKQSTKTEEKLRAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6213 - protein, 655 aa, Homo sapiens
MVKEKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6214 - protein, 846 aa, Homo sapiens
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPELLSPGVQRLSYLRTSSLSPTHSDSRPNPPFRHHFIPHIKGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVREYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6215 - protein, 702 aa, Homo sapiens
MVPDPVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVREYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6216 - protein, 455 aa, Homo sapiens
MFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6217 - protein, 746 aa, Homo sapiens
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6218 - protein, 304 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 6219 - protein, 211 aa, Homo sapiens
MSCTIEKILTDAKTLLERLREHDAAAESLVDQSAALHRRVAAMREAGTALPDQVRQRYQEDASDMKDMSKYKPHILLSQENTQIRDLQQENRELWISLEEHQDALELIMSKYRKQMLQLMVAKKAVDAEPVLKAHQSHSAEIESQIDRICEMGEVMRKAVQVDDDQFCKIQEKLAQLELENKELRELLSISSESLQARKENSMDTASQAIK

SEQ ID NO: 6220 - protein, 816 aa, Homo sapiens
MVLMFQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 6221 - protein, 1165 aa, Homo sapiens
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 6222 - protein, 1165 aa, Homo sapiens; identical to SEQ ID NO: 6221

SEQ ID NO: 6223 - protein, 1210 aa, Homo sapiens
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 6224 - protein, 1075 aa, Homo sapiens
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQVSAMGYCLLFGPCTVVTFWRTLLLAGC

SEQ ID NO: 6225 - protein, 180 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 6226 - protein, 238 aa, Homo sapiens
MSEDLAKQLASYKAQLQQVEAALSGNGENEDLLKLKKDLQEVIELTKDLLSTQPSETLASSDSFASTQPTHSWKVGDKCMAVWSEDGQCYEAEIEEIDEENGTAAITFAGYGNAEVTPLLNLKPVEEGRKAKEDSGNKPMSKKEMIAQQREYKKKKALKKAQRIKELEQEREDQKVKWQQFNNRAYSKNKKGQVKRSIFASPESVTGKVGVGTCGIADKPMTQYQDTSKYNVRHLMPQ

SEQ ID NO: 6227 - protein, 238 aa, Homo sapiens; identical to SEQ ID NO: 6226

SEQ ID NO: 6228 - protein, 742 aa, Homo sapiens
DLSSGGGIEPQCSSEVYFRARERGCENVAWSLGLRSHCFLEAELHPLPWFLPTNVCSPLPGAAHKLVCYFTNWAHSRPGPASILPHDLDPFLCTHLIFAFASMNNNQIVAKDLQDEKILYPEFNKLKERMWQQLPTGVKNPAHQPSLSHHRNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 6229 - protein, 678 aa, Homo sapiens
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 6230 - protein, 334 aa, Homo sapiens
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 6231 - protein, 594 aa, Homo sapiens
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 6232 - protein, 499 aa, Homo sapiens
MSFGSEHYLCSSSSYRKVFGDGSRLSARLSGAGGAGGFRSQSLSRSNVASSAACSSASSLGLGLAYRRPPASDGLDLSQAAARTNEYKIIRTNEKEQLQGLNDRFAVFIEKVHQLETQNRALEAELAALRQRHAEPSRVGELFQRELRDLRAQLEEASSARSQALLERDGLAEEVQRLRARCEEESRGREGAERALKAQQRDVDGATLARLDLEKKVESLLDELAFVRQVHDEEVAELLATLQASSQAAAEVDVTVAKPDLTSALREIRAQYESLAAKNLQSAEEWYKSKFANLNEQAARSTEAIRASREEIHEYRRQLQARTIEIEGLRGANESLERQILELEERHSAEVAGYQDSIGQLENDLRNTKSEMARHLREYQDLLNVKMALDIEIAAYRKLLEGEETRFSTSGLSISGLNPLPNPSYLLPPRILSATTSKVSSTGLSLKKEEEEEEASKVASKKTSQIGESFEEILEETVISTKKTEKSNIEETTISSQKI

SEQ ID NO: 6233 - protein, 376 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 6234 - protein, 260 aa, Homo sapiens
MSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEVKGKEKRKKHL

SEQ ID NO: 6235 - protein, 296 aa, Homo sapiens
MEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 6236 - protein, 699 aa, Homo sapiens
MADAGIRRVVPSDLYPLVLGFLRDNQLSEVANKFAKATGATQQDANASSLLDIYSFWLKSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 6237 - protein, 424 aa, Homo sapiens
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKARQGLTMLPRLVLNFHPQAILLPHLPKMLRLQVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSVIADSIPLSSDGSAVVADLRNYFDEQFEF

SEQ ID NO: 6238 - protein, 393 aa, Homo sapiens
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSVIADSIPLSSDGSAVVADLRNYFDEQFEF

SEQ ID NO: 6239 - protein, 566 aa, Homo sapiens
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 6240 - protein, 49 aa, Homo sapiens
MAGPRVEVDGSIMEGGGQILRVSTALSCLLGLPLRVQKIRAGRSTPGLR

SEQ ID NO: 6241 - protein, 366 aa, Homo sapiens
MAGPRVEVDGSIMEGGGQILRVSTALSCLLGLPLRVQKIRAGRSTPGLRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGNGNGIIIIAETSTGCLFAGSSLGKRGVNADKVGIEAAEMLLANLRHGGTVDEYLQDQLIVFMALANGVSRIKTGPVTLHTQTAIHFAEQIAKAKFIVKKSEDEEDAAKDTYIIECQGIGMTNPNL

SEQ ID NO: 6242 - protein, 384 aa, Homo sapiens; identical to SEQ ID NO: 5748

SEQ ID NO: 6243 - protein, 267 aa, Homo sapiens
MAEPVQEELSVLAAIFCRPHEWEVLSRSETDGTVFRIHTKAEGFMDVDIPLELVFHLPVNYPSCLPGISINSEQLTRAQCVTVKENLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKEYLILQKTSKVDVDSSGKKCKEKMISVLFETKVQTEHKRFLAFEVKEYSALDELQKEFETAGLKKLFSEFVLALVK

SEQ ID NO: 6244 - protein, 669 aa, Homo sapiens
MAIVQTLPVPLEPAPEAATAPQAPVMGSVSSLISGRPCPGGPAPPRHHGPPGPTFFRQQDGLLRGGYEAQEPLCPAVPPRKAVPVTSFTYINEDFRTESPPSPSSDVEDAREQRAHNAHLRGPPPKLIPVSGKLEKNMEKILIRPTAFKPVLPKPRGAPSLPSFMGPRATGLSGSQGSLTQLFGGPASSSSSSSSSSAADKPLAFSGWASGCPSGTLSDSGRNSLSSLPTYSTGGAEPTTSSPGGHLPSHGSGRGALPGPARGVPTGPSHSDSGRSSSSKSTGSLGGRVAGGLLGSGTRASPDSSSCGERSPPPPPPPPSDEALLHCVLEGKLRDREAELQQLRDSLDENEATMCQAYEERQRHWQREREALREDCAAQAQRAQRAQQLLQLQVFQLQQEKRQLQDDFAQLLQEREQLERRCATLEREQRELGPRLEETKWEVCQKSGEISLLKQQLKESQAELVQKGSELVALRVALREARATLRVSEGRARGLQEAARARELELEACSQELQRHRQEAEQLREKAGQLDAEAAGLREPPVPPATADPFLLAESDEAKVQRAAAGVGGSLRAQVERLRVELQRERRRGEEQRDSFEGERLAWQAEKEQVIRYQKQLQHNYIQMYRRNRQLEQELQQLSLELEARELADLGLAEQAPCICLEEITATEI

SEQ ID NO: 6245 - protein, 669 aa, Homo sapiens; identical to SEQ ID NO: 6244

SEQ ID NO: 6246 - protein, 352 aa, Homo sapiens [sequence omitted]

SEQ ID NO: 6247 - protein, 1179 aa, Homo sapiens
MKLKELERPAVQAWSPASQYPLYLATGTSAQQLDSSFSTNGTLEIFEVDFRDPSLDLKHRGVLSALSRFHKLVWGSFGSGLLESSGVIVGGGDNGMLILYNVTHILSSGKEPVIAQKQKHTGAVRALDLNPFQGNLLASGASDSEIFIWDLNNLNVPMTLGSKSQQPPEDIKALSWNRQAQHILSSAHPSGKAVVWDLRKNEPIIKVSDHSNRMHCSGLAWHPDIATQLVLCSEDDRLPVIQLWDLRFASSPLKVLESHSRGILSVSWSQADAELLLTSAKDSQILCRNLGSSEVVYKLPTQSSWCFDVQWCPRDPSVFSAASFNGWISLYSVMGRSWEVQHMRQADKISSSFSKGQPLPPLQVPEQVAQAPLIPPLKKPPKWIRRPTGVSFAFGGKLVTFGLPSTPAHLVPQPCPRLVFISQVTTESEFLMRSAELQEALGSGNLLNYCQNKSQQALLQSEKMLWQFLKVTLEQDSRMKFLKLLGYSKDELQKKVATWLKSDVGLGESPQPKGNDLNSDRQQAFCSQASKHTTKEASASSAFFDELVPQNMTPWEIPITKDIDGLLSQALLLGELGPAVELCLKEERFADAIILAQAGGTDLLKQTQERYLAKKKTKISSLLACVVQKNWKDVVCTCSLKNWREALALLLTYSGTEKFPELCDMLGTRMEQEGSRALTSEARLCYVCSGSVERLVECWAKCHQALSPMALQDLMEKVMVLNRSLEQLRGPHGVSPGPATTYRVTQYANLLAAQGSLATAMSFLPRDCAQPPVQQLRDRLFHAQGSAVLGQQSPPFPFPRIVVGATLHSKETSSYRLGSQPSHQVPTPSPRPRVFTPQSSPAMPLAPSHPSPYQGPRTQNISDYRAPGPQAIQPLPLSPGVRPASSQPQLLGGQRVQVPNPVGFPGTWPLPGSPLPMACPGIMRPGSTSLPETPRLFPLLPLRPLGPGRMVSHTPAPPASFPVPYLPGDPGAPCSSVLPTTGILTPHPGPQDSWKEAPAPRGNLQRNKLPETFMPPAPITAPVMSLTPELQGILPSQPPVSSVSHAPPGVPGELSLQLQHLPPEKMERKELPPEHQSLKSSFEALLQRCSLSATDLKTKRKLEEAAQRLEYLYEKLCEGTLSPHVVAGLHEVARCVDAGSFEQGLAVHAQVAGCSSFSEVSSFMPILKAVLIIAHKLLV

SEQ ID NO: 6248 - protein, 544 aa, Homo sapiens; identical to SEQ ID NO: 4983

SEQ ID NO: 6249 - protein, 562 aa, Homo sapiens; identical to SEQ ID NO: 5858

SEQ ID NO: 6250 - protein, 562 aa, Homo sapiens; identical to SEQ ID NO: 5858

SEQ ID NO: 6251 - protein, 423 aa, Homo sapiens
MEDKRSLSMARCEERNSRGQDHGLERVPFPPQLQSETYLHPADPSPAWDDPGSTGSPNLRLLTEEIAFQPLAEEASFRRPHPDGDVPPQGEDNLLSLPFPQKLWRLVSSNQFSSIWWDDSGACRVINQKLFEKEILKRDVAHKVFATTSIKSFFRQLNLYGFRKRRQCTFRTFTRIFSAKRLVSILNKLEFYCHPYFQRDSPHLLVRMKRRVGVKSAPRHQEEDKPEAAGSCLAPADTEQQDHTSPNENDQVTPQHREPAGPNTQIRSGSAPPATPVMVPDSAVASDNSPVTQPAGEWSEGSQAHVTPVAAVPGPAALPFLYVPGSPTQMNSYGPVVALPTASRSTLAMDTTGLPAPGMLPFCHLWVPVTLVAAGAAQPAASMVMFPHLPALHHHCPHSHRTSQYMPASDGPQAYPDYADQST

SEQ ID NO: 6252 - protein, 224 aa, Homo sapiens
MPTLFKGVWGVVEHSRALGRFCPACLPSGPHLHTQPALGTAEMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLNSLVLKKGCTNYINLGSFLIKPVQRVMRYPLLLMEL

SEQ ID NO: 6253 - protein, 625 aa, Homo sapiens
MRLPERHGGPQGSLCLMDPCCPLSLALQDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 6254 - protein, 461 aa, Homo sapiens
MDDPDCDSTWEEDEEDAEDAEDEDCEDGEAAGARDADAGDEDEESEEPRAARPSSFQSRMTGSRNWRATRDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGESSCPCCRGWGLRSCCGLPSGSAS

SEQ ID NO: 6255 - protein, 512 aa, Homo sapiens
MPSPSRSGRSRCLKAPRRSRSGLSGPTSSCWASTIRLEDRGTGTVGRAQNYQKRFQNLNWRSHNNLRITRILKSLGELGLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCGPEHSKGGGRVDEGPQPRSVEPQDAGPLERSQGDEAGGHGEDRPEPLSPKESKKRKLELSRREQPPTEPGPQSASEVEKIALNLEGCALSQGSLRTGTQEVGGQDPGEAVQPCRQPLGARVADKVRKRRKVDEGAGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 6256 - protein, 103 aa, Homo sapiens
MGQQSSVRRLKRSVPCESNEANEANEANKTMPETPTGDSDPQPAPKKMKTSESSTILVVRYRRNVKRTSPEELVNDHARENRINPDQMEEEEFIEITTERPKK

SEQ ID NO: 6257 - protein, 591 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 6258 - protein, 644 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 6259 - protein, 841 aa, Homo sapiens
MMADGAAAGAGGSPSLRELRARMVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTGKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 6260 - protein, 858 aa, Homo sapiens
MTSPRVAAANEIAKERRKQDVVNRVATHSSNIRSTFKPVIDGSMLKNDIKQRLARERREEKRRQQDANKETQLLEKERKTKLQYEKQMEERQRKLKERKEKEEQRRIAAEEKRHQKDEAQKEKFTAILYRTLERRRLADDYQQKRWSWGGSAMANSESKTANKRSASTEKLEQGTSALIRQMPLSSAGLQNSVAKRKTDKERSSSLNRRDSNLHSSTDKEQAERKPRVTGVTNYVMQYVTVPLRKCTSDELRAVMFPMSTMKIPPQTKVEESPLEKVETPPKASVDAPPQVNVEVFCNTSMEASPKAGVGMAPEVSTDSFPVVSVDVSPVVSTYDSEMSMDASPELSIEALPKVDLETVPKVSIVASPEASLEAPPEVSLEALPEVSVEAAPEGSLEAPPKGSAEVAPKESVKGSPKESMEASPEAMVKASPKTSLEASMEASPKAKARDAPKKSEMDKQALIPIAKKRLSSYTECYKWSSSPENACGLPSPISTNRQIQKNCPPSPLPLISKQSPQTSFPYKIMPIQHTLSVQSASSTVKKKKETVSKTTNRCEALSQRHMIYEESGNKSTAGIMNAEAATKILTELRRLAREQREKEEEERQREEMQQRVIKKSKDMAKEAVGGQAEDHLKLKDGQQQNETKKKKGWLDQEDQEAPLQKGDAKIKAQEEADKRKKEHERIMLQNLQERLERKKRIEEIMKRTRKTDVNASKVTETSSHDIYEEAEADNEESDKDSLNEMFPSAILNGTGSPTKFKMPFNNAKKMTHKLVFLEDGTSQVRKEPKTYFNGDLKNFRQKSMKDTSIQEVVSRPSSKRMTSHTTKTRKADETNTTSRSSAQTKSEGFHDILPKSSDTFRQ

SEQ ID NO: 6261 - protein, 315 aa, Homo sapiens
MPLKLRGKKKAKSKETAGLVEGEPTGAGGGSLSASRAPARRLVFHAQLAHGSATGRVEGFSSIQELYAQIAGAFEISPSEILYCTLNTPKIDMERLLGGQLGLEDFIFAHVKGIEKEVNVYKSEDSLGLTITDNGVGYAFIKRIKDGGVIDSVKTICVGDHIESINGENIVGWRHYDVAKKLKELKKEELFTMKLIEPKKAFEIELRSKAGKSSGEKIGCGRATLRLRSKGPATVEEMPSETKAKAIEKIDDVLELYMGIRDIDLATTMFEAGKDKVNPDEFAVALDETLGDFAFPDEFVFDVWGVIGDAKRRGL

SEQ ID NO: 6262 - protein, 828 aa, Homo sapiens
MTGSNSHITILTLKVLPHFESLGKQEKIPNKMSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRVKK

SEQ ID NO: 6263 - protein, 942 aa, Homo sapiens; identical to SEQ ID NO: 5931

SEQ ID NO: 6264 - protein, 911 aa, Homo sapiens
MSAFRNHCPHLDSVGEITKEDLIQKSLGTCQDCKVQGPNLWACLENRCSYVGCGESQVDHSTIHSQETKHYLTVNLTTLRVWCYACSKEVFLDRKLGTQPSLPHVRQPHQIQENSVQDFKIPSNTTLKTPLVAVFDDLDIEADEEDELRARGLTGLKNIGNTCYMNAALQALSNCPPLTQFFLDCGGLARTDKKPAICKSYLKLMTELWHKSRPGSVVPTTLFQGIKTVNPTFRGYSQQDAQEFLRCLMDLLHEELKEQVMEVEEDPQTITTEETMEEDKSQSDVDFQSCESCSNSDRAENENGSRCFSEDNNETTMLIQDDENNSEMSKDWQKEKMCNKINKVNSEGEFDKDRDSISETVDLNNQETVKVQIHSRASEYITDVHSNDLSTPQILPSNEGVNPRLSASPPKSGNLWPGLAPPHKKAQSASPKRKKQHKKYRSVISDIFDGTIISSVQCLTCDRVSVTLETFQDLSLPIPGKEDLAKLHSSSHPTSIVKAGSCGEAYAPQGWIAFFMEYVKRFVVSCVPSWFWGPVVTLQDCLAAFFARDELKGDNMYSCEKCKKLRNGVKFCKVQNFPEILCIHLKRFRHELMFSTKISTHVSFPLEGLDLQPFLAKDSPAQIVTYDLLSVICHHGTASSGHYIAYCRNNLNNLWYEFDDQSVTEVSESTVQNAEAYVLFYRKSSEEAQKERRRISNLLNIMEPSLLQFYISRQWLNKFKTFAEPGPISNNDFLCIHGGVPPRKAGYIEDLVLMLPQNIWDNLYSRYGGGPAVNHLYICHTCQIEAEKIEKRRKTELEIFIRLNRAFQKEDSPATFYCISMQWFREWESFVKGKDGDPPGPIDNTKIAVTKCGNVMLRQGADSGQISEETWNFLQSIYGGGPEVILRPPVVHVDPDILQAEEKIEVETRSL

SEQ ID NO: 6265 - protein, 154 aa, Homo sapiens
MAPPVRYCIPGERLCNLEEGSPGSGTYTRHGYIFSSLAGCLMKSSENGALPVVSVVRETESQLLPDVGAIVTCKVEIYKSFRPGDIVLAKVISLGDAQSNYLLTTAENELGVVVAHSESGIQMVPISWCEMQCPKTHTKEFRKVARVQPEFLQT

SEQ ID NO: 6266 - protein, 170 aa, Homo sapiens
MAPPVRYCIPGERLCNLEEGSPGSGTYTRHGYIFSSLAGCLMKSSENGAVSSINSRFAKVHILYVGSMPLKNSFRGTIRKEDVRATEKDKVEIYKSFRPGDIVLAKVISLGDAQSNYLLTTAENELGVVVAHSESGIQMVPISWCEMQCPKTHTKEFRKVARVQPEFLQT

SEQ ID NO: 6267 - protein, 178 aa, Homo sapiens
MAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKISLGDAQSNYLLTTAENELGVVVAHSESGIQMVPISWCEMQCPKTHTKEFRKVARVQPEFLQT

SEQ ID NO: 6268 - protein, 936 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQGLSLEEMKRSLQYTPIDKYGYVSDPMSSMHFHSCRNSSSFEDSS

SEQ ID NO: 6269 - protein, 169 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSVSFQIYQNALAKHPVSFKAYWIQDVLWHLAQLWSIPDWGLMFQLGKTALLVVLTS

SEQ ID NO: 6270 - protein, 594 aa, Homo sapiens
MAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLGNPIYQMLELKLAMYIDFPLNMNPGILVTCADDIELYSIGEFEFIRFDKPGFTALAHPSSLTIGTTHGVFVLDPFDDLKHRDLEYRSCHRFLHKPSIEKMYQFNAVCRPGNFCQQDFAGGDIADLKLDSDYVYTDSLFYMDHKSAKMLLAFYEKIGTLSCEIDAYGDFLQALGPGATVEYTRNTSNVIKEESELVEMRQRIFHLLKGTSLNVVVLNNSKFYHIGTTEEYLFYFTSDNSLKSELGLQSITFSIFPDIPECSGKTSCIIQSILDSRCSVAPGSVVEYSRLGPDVSVGENCIISGSYILTKAALPAHSFVCSLSLKMNRCLKYATMAFGVQDNLKKSVKTLSDIKLLQFFGVCFLSCLDVWNLKVTEELFSGNKTCLSLWTARIFPVCSSLSDSVITSLKMLNAVKNKSAFSLNSYKLLSIEEMLIYKDVEDMITYREQIFLEISLKSSLM

SEQ ID NO: 6271 - protein, 195 aa, Homo sapiens
MAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVEIYKSFRPGDIVLAKVISLGDAQSNYLLTTAENELGVVVAHSESGIQMVPISWCEMQCPKTHTKEFRKVARVQPEFLQT

SEQ ID NO: 6272 - protein, 541 aa, Homo sapiens
MTGEKIRSLRRDHKPSKEEGDLLEPGDEEAAAALGGTFTRSRIGKGGKACHKIFSNHHHRLQLKAAPASSNPPGAPALPLHNSSVTANSQSPALLAGTNPVAVVADGGSCPAHYPVHECVFKGDVRRLSSLIRTHNIGQKDNHGNTPLHLAVMLGNKECAHLLLAHNAPVKVKNAQGWSPLAEAISYGDRQMITALLRKLKQQSRESVEEKRPRLLKALKELGDFYLELHWDFQSWVPLLSRILPSDACKIYKQGINIRLDTTLIDFTDMKCQRGDLSFIFNGDAAPSESFVVLDNEQKVYQRIHHEESEMETEEEVDILMSSDIYSATLSTKSISFTRAQTGWLFREDKTERVGNFLADFYLVNGLVLESRKRREHLSEEDILRNKAIMESLSKGGNIMEQNFEPIRRQSLTPPPQNTITWEEYISAENGKAPHLGRELVCKESKKTFKATIAMSQEFPLGIELLLNVLEVVAPFKHFNKLREFVQMKLPPGFPVKLDIPVFPTITATVTFQEFRYDEFDGSIFTIPDDYKEDPSRFPDL

SEQ ID NO: 6273 - protein, 279 aa, Homo sapiens
MPCRREEEEEAGEEAEGEEEEEDSFLLLQQSVALGSSGEVDRLVAQIGETLQLDAAQHSPASPCGPPGAPLRAPGPLAAAVPADKARSPAVPLLLPPALAETVGPAPPGVLRCALGDRGRVRGRAAPYCVAELATGPSALSPLPPQADLDGPPGAGKQGIPQPLSGPCRRGWLRGAAASRRLQQRRGSQPETRTGDDDPHRLLQQLVLSGNLIKEAVRRLHSRRLQLRAKLPQRPLLGPLSAPVHEPPSPRSPRAACSDPGASGRAQLRTGDGVLVPGS

SEQ ID NO: 6274 - protein, 402 aa, Homo sapiens
MPLHSSLGNKSETLSQKKNNNNKEKTKRNSRNPPRTALKEGKMEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVDGLLFYHKQTHYSPGSTPLVGWLRPYMVSDVLGVAVPAGPLTTKPDYAGHQLQQIMEHKKSQKEGMKEKLTHKASENGHYELEHLSTPKLKGSSHSPDHPGCLMEN

SEQ ID NO: 6275 - protein, 368 aa, Homo sapiens
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 6276 - protein, 183 aa, Homo sapiens
MRKSSCVESFDDQRRMSLHLHGADCDPKTQNEMNICEEEFVEYKNRDAISALMPLFSEEESSDGSKHNNGLPDHISAQLQNTYTLKAFTVGSKCVVWSSLRNTWSKCEILETAEEGTRVLNLSNGMEEIVNPENVWNGIPKLDKSPPEAVSQRVGKDLYFMSVGDTTIKEKGFGGDGDLTVDL

SEQ ID NO: 6277 - protein, 606 aa, Homo sapiens
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQPPALFSALQEQKVYVQHRLRELGSLVWELLDRQGAYFYLAGNAKSMPADVSEALMSIFQEEGGLCSPDAAAYLARLQQTRRFQTETWA

SEQ ID NO: 6278 - protein, 139 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGECPSTLRRVR

SEQ ID NO: 6279 - protein, 141 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIDVGTRSARVLRAQ

SEQ ID NO: 6280 - protein, 49 aa, Homo sapiens
MATQRKHLVKDFNPYITCYICKGYLIKPTTVTECLHTSAESYWMSTWMS

SEQ ID NO: 6281 - protein, 319 aa, Homo sapiens
MMVLKVEELVTGKKNGNGEAGEFLPEDFRDGEYEAAVTLEKQEDLKTLLAHPVTLGEQQWKSEKQREAELKKKKLEQRSKLENLEDLEIIIQLKKRKKYRKTKVPVVKEPEPEIITEPVDVPTFLKAALENKLPVVEKFLSDKNNPDVCDEYKRTALHRACLEGHLAIVEKLMEAGAQIEFRDMLESTAIHWASRGGNLDVLKLLLNKGAKISARDKLLSTALHVAVRTGHYECAEHLIACEADLNAKDREGDTPLHDAVRLNRYKMIRLLIMYGADLNIKNCAGKTPMDLVLHWQNGTKAIFDSLRENSYKTSRIATF

SEQ ID NO: 6282 - protein, 362 aa, Homo sapiens
MSGYQRRPGATPLSRARSLAIPDDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 6283 - protein, 1820 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 6284 - protein, 494 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 6285 - protein, 502 aa, Homo sapiens
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFESFPLKQVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 6286 - protein, 496 aa, Homo sapiens; identical to SEQ ID NO: 5715

SEQ ID NO: 6287 - protein, 490 aa, Homo sapiens
MSEVTKNSLEKILPQLKCHFTWNLFKEDSVSRDLEDRVCNQIEFLNTEFKATMYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 6288 - protein, 490 aa, Homo sapiens; identical to SEQ ID NO: 6287

SEQ ID NO: 6289 - protein, 502 aa, Homo sapiens; identical to SEQ ID NO: 6285

SEQ ID NO: 6290 - protein, 217 aa, Homo sapiens
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPAGRWSW

SEQ ID NO: 6291 - protein, 320 aa, Homo sapiens
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPVSN

SEQ ID NO: 6292 - protein, 503 aa, Homo sapiens
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEAYMKLGRNVARTFLDYYRLNPVVEKVAIPMPRLRNKEIEVQRRKEKSPPYKHPLLRGPASNYPNSKGDKKSSVNHKDPSTPF

SEQ ID NO: 6293 - protein, 577 aa, Homo sapiens
MSQVQVQVQNPSAALSGSQILNKNQSLLSQPLMSIPSTTSSLPSENAGRPIQNSALPSASITSTSAAAESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 6294 - protein, 283 aa, Homo sapiens
MSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEAVKYRPRAAGGLCLKTSTEKVCAVWSDDLRRA

SEQ ID NO: 6295 - protein, 368 aa, Homo sapiens
MSYFGKFYLVGLDARKAADWLFSADVSRPPGSTVYTCMLNHRGGTESDLTVSRLAPSHQASPLAPAFEGDGYYLAMGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEEPLWTRPHPAVSGAPAFSTASSSKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 6296 - protein, 918 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYTCMLNHRGGTESDLTVSRLAPSHQASPLAPAFEGDGYYLAMGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEDKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 6297 - protein, 239 aa, Homo sapiens
MEGTVESQTPDLRDVEGKVGRKTPEGLLRGLRGECELGTSGALLLPGASSTGHDLGDKIMALKMELAYLRAIDVKILQQLVTLNEGIEAVRWLLEERGTLTSHCSSLTSSQYSLTGGSPGRSRRGSWDSLPDTSTTDRLDSVSIGSFLDTVAPSELDEQGPPGAPRSEMDWAKVIAGGERARTEVDVAATRLGSLRAVWKPPGERLQGGPPESPEDESAKLGFEAHWFWEQCQDDVTFL

SEQ ID NO: 6298 - protein, 97 aa, Homo sapiens
MSSGNAKIGHPAPNFKATADEGISFRGLFIIDDKGILRQITVNDLPVGRSVDETLRLVQAFQFTDKHGEVCPAGWKPGSDTIKPDVQKSKEYFSKQK

SEQ ID NO: 6299 - protein, 555 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 6300 - protein, 542 aa, Homo sapiens; identical to SEQ ID NO: 5726

SEQ ID NO: 6301 - protein, 571 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 6302 - protein, 471 aa, Homo sapiens
MLGSWGCYRYAKLFSCSLSTHARFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 6303 - protein, 274 aa, Homo sapiens
MAAPEAEVLSSAAVPDLEWYEKSEETHASQIELLETSSTQEPLNASEAFCPRDCMVPVVFPGPVSQEGCCQFTCELLKHIMYQRQQLPLPYEQLKHFYRKPSPQAEEMLKKKPRATTEVSSRKCQQALAELESVLSHLEDFFARTLVPRVLILLGGNALSPKEFYELDLSLLAPYSVDQSLSTAACLRRLFRAIFMADAFSELQAPPLMGTVVMAQGHRNCGEDWFRPKLNYRVPSRGHKLTVTLSCGRPSIRTTAWEDYIWFQAPVTFKGFRE

SEQ ID NO: 6304 - protein, 861 aa, Homo sapiens
MAGPGPGAVLESPRQLLGRVRFLAEAARSLRAGRPLPAALAFVPREVLYKLYKDPAGPSRVLLPVWEAEGLGLRVGAAGPAPGTGSGPLRAARDSIELRRGACVRTTGEELCNGHGLWVKLTKEQLAEHLGDCGLQEGWLLVCRPAEGGARLVPIDTPNHLQRQQQLFGVDYRPVLRWEQVVDLTYSHRLGSRPQPAEAYAEAVQRLLYVPPTWTYECDEDLIHFLYDHLGKEDENLGSVKQYVESIDVSSYTEEFNVSCLTDSNADTYWESDGSQCQHWVRLTMKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 6305 - protein, 398 aa, Homo sapiens
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 6306 - protein, 566 aa, Homo sapiens; identical to SEQ ID NO: 5875

SEQ ID NO: 6307 - protein, 309 aa, Homo sapiens
MPRARSGRRSRGAGGREETFLRVRANRQTRLNARIGKMKRRKQDEGQVCPLCNRPLAGSEQEMSRHVEHCLSKREGSCMAEDDAVDIEHENNNRFEEYEWCGQKRIRATTLLEGGFRGSGFIMCSGKENPDSDADLDVDGDDTLEYGKPQYTEADVIPCTGEEPGEAKEREALRGAVLNGGPPSTRITPEFSKWASDAEMPSTSNGESSKQEAMQKTCKNSDIEKITEDSAVTTFEALKARVRELERQLSRGDRYKCLICMDSYSMPLTSIQCWHVHCEECWLRTLGAKKLCPQCNTITAPGDLRRIYL

SEQ ID NO: 6308 - protein, 374 aa, Homo sapiens
MESVLSKYEDQITIFTDYLEEYPDTDELVWILGKQHLLKTGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 6309 - protein, 185 aa, Homo sapiens
MEGCVSNLMVCNLAYSGKLEELKESILADKSLATRTDQDSRTALHWACSAGHTEIVEFLLQLGVPVNDKDDAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 6310 - protein, 110 aa, Homo sapiens
MEGCVSNLMVCNLAYSGKLEELKESILADKSLATRTDQDSRTALHWACSAGHTEIVEFLLQLGVPVNDKDDAASKNRHEIAVMLLEGGANPDAKDHYEATAMHRAAAKDT

SEQ ID NO: 6311 - protein, 181 aa, Homo sapiens
MVLGAGWGWAYQLHLLQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 6312 - protein, 963 aa, Homo sapiens
MERREEQPGAAGAGAAPALDFTVENVEKALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 6313 - protein, 968 aa, Homo sapiens
MRLLRHTESEQWFHRFPLCPSLTFWAPVAMWPQTHCVGGRSSGLTKWTYSFSASLQDGSFPYDSVPWQQNTNQPPGSLSVVTTVWGVTNTSQSQADVLIPHATCRPGPLLITAWEPYGQCQQPHESRRQPHGVGHDHQQPRPQLPTVCGAAAAVLSQGWPRSALHPAEHVWPAQLPRQRGLWGQPAAAAAAAAVAAAAATATATATATVAALQETQNKDINQYGPAPVLLPDLLKDGLGDEERGAPIGMQNSMNPASMAAGMTPSGMSGPPMGMNQPRPPGISPFGTHGQRMPQQTYPGPRPQSLPIQNIKRPYPGEPNYGNQQYGPNSQFPTQPGQYPAPNPPRPLTSPNYPGQRMPSQPSSGQYPPPTVNMGQYYKPEQFNGQNNTFSGSSYSNYSQGNVNRPPRPVPVANYPHSPVPGNPTPPMTPGSSIPPYLSPSQDVKPPFPPDIKPNMSALPPPPDHNDELRLTFPVRDGVVLEPFRLEHNLAVSNHVFHLRPTVHQTLMWSDLELQFKCYHHEDRQMNTNWPASVQVSVNATPLTIERGDNKTSHKPLHLKHVCQPGRNTIQITVTACCCSHLFVLQLVHRPSVRSVLQGLLKKRLLPAEHCITKKRNFSSVAASSGNTTLNGEDGVEQTAIKVSLKCPITFRRIQLPARGHDCKHVQCFDLESYLQLNCERGTWRCPVCKTALLEGLEVDQYMWGILNAIHSEFEEVTIDPTCSWRPVPIKSDLHIKDDPDGIPSKRFKTMSPSQMIMPNVMEMIAALGPGPSPYPLPPPPGGTNSNDYSSQNNYQGHGNFDFPHGNPGGTSMNDFMHGPPQLSHPPDMPNNMAALEKPLSHPMQETMPHAGSSDQPHPSIQQGLHVPHPSSQSGPPLHHSGAPPPPPSQPPRQPPQAAPSSHPHSDLTFNPSSALEGQAGAQGASDMPEPSLDLLPELTNPDELLSYLDPPDLPSNSNDDLLSLFENN

SEQ ID NO: 6314 - protein, 200 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKTHFHDLPCGASVILGNNGFIWIYPTPEHKEEEAGG

SEQ ID NO: 6315 - protein, 263 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITERRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 6316 - protein, 285 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 6317 - protein, 293 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 6318 - protein, 1064 aa, Homo sapiens
MASESETLNPSARIMTFYPTMEEFRNFSRYIAYIESQGAHRAGLAKVVPPKEWKPRASYDDIDDLVIPAPIQQLVTGQSGLFTQYNIQKKAMTVREFRKIANSDKYCTPRYSEFEELERKYWKNLTFNPPIYGADVNGTLYEKHVDEWNIGRLRTILDLVEKESGITIEGVNTPYLYFGMWKTSFAWHTEDMDLYSINYLHFGEPKSWYSVPPEHGKRLERLAKGFFPGSAQSCEAFLRHKMTLISPLMLKKYGIPFDKVTQEAGEFMITFPYGYHAGFNHGFNCAESTNFATRRWIEYGKQAVLCSCRKDMVKISMDVFVRKFQPERYKLWKAGKDNTVIDHTLPTPEAAEFLKESELPPRAGNEEECPEEDMEGVEDGEEGDLKTSLAKHRIGTKRHRVCLEIPQEVSQSELFPKEDLSSEQYEMTECPAALAPVRPTHSSVRQVEDGLTFPDYSDSTEVKFEELKNVKLEEEDEEEEQAAAALDLSVNPASVGGRLVFSGSKKKSSSSLGSGSSRDSISSDSETSEPLSCRAQGQTGVLTVHSYAKGDGRVTVGEPCTRKKGSAARSFSERELAEVADEYMFSLEENKKSKGRRQPLSKLPRHHPLVLQECVSDDETSEQLTPEEEAEETEAWAKPLSQLWQNRPPNFEAEKEFNETMAQQAPHCAVCMIFQTYHQVEFGGFNQNCGNASDLAPQKQRTKPLIPEMCFTSTGCSTDINLSTPYLEEDGTSILVSCKKCSVRVHASCYGVPPAKASEDWMCSRCSANALEEDCCLCSLRGGALQRANDDRWVHVSCAVAILEARFVNIAERSPVDVSKIPLPRFKLKCIFCKKRRKRTAGCCVQCSHGRCPTAFHVSCAQAAGVMMQPDDWPFVVFITCFRHKIPNLERAKGALQSITAGQKVISKHKNGRFYQCEVVRLTTETFYEVNFDDGSFSDNLYPEDIVSQDCLQFGPPAEGEVVQVRWTDGQVYGAKFVASHPIQMYQVEFEDGSQLVVKRDDVYTLDEELPKRVKSRLSVASDMRFNEIFTEKEVKQEKKRQRVINSRYREDYIEPALYRAIME

SEQ ID NO: 6319 - protein, 914 aa, Homo sapiens; identical to SEQ ID NO: 5366

SEQ ID NO: 6320 - protein, 404 aa, Homo sapiens
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATCEGDTVPDFQETRPRNYILSASASALWNDEVDKAEQELRVAQTEFDRQAEVTRLLLEGISSTHVNHLRCLHEFVKSQTTYYAQCYRHMLDLQKQLGSSQGAIFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 6321 - protein, 395 aa, Homo sapiens
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASALWNDEVDKAEQELRVAQTEFDRQAEVTRLLLEGISSTHVNHLRCLHEFVKSQTTYYAQCYRHMLDLQKQLGRFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 6322 - protein, 395 aa, Homo sapiens; identical to SEQ ID NO: 6321

SEQ ID NO: 6323 - protein, 204 aa, Homo sapiens
MSWTCPRCQQPVFFAEKVSSLGKNWHRFCLKCERCHSILSPGGHAEHNGRPYCHKPCYGALFGPRGVNIGGVGSYLYNPPTPSPGCTTPLSPSSFSPPRPRTGLPQGKKSPPHMKTFTGETSLCPGCGEPVYFAEKVMSLGRNWHRPCLRCQRCHKTLTAGSHAEHDGVPYCHVPCYGYLFGPKGVNIGDVGCYIYDPVKIKFK

SEQ ID NO: 6324 - protein, 406 aa, Homo sapiens
MESLRGYTHSDIGYRSLAVGEDIEEVNDEKLTVTSLMARGGEDEENTRSKPEYGTEAENNVGTEGSVPSDDQDREGGGGHEPEQQQEEPPLTKPEQQQEEPPLLELKQEQEEPPQTTVEGPQPAEGPQTAEGPQPPERKRRRRTAFTQFQLQELENFFDESQYPDVVARERLAARLNLTEDRVQVWFQNRRAKWKRNQRVLMLRNTATADLAHPLDMFLGGAYYAAPALDPALCVHLVPQLPRPPVLPVPPMPPRPPMVPMPPRPPIAPMPPMAPVPPGSRMAPVPPGPRMAPVPPWPPMAPVPPWPPMAPVPTGPPMAPVPPGPPMARVPPGPPMARVPPGPPMAPLPPGPPMAPLPPGPPMAPLPPGPPMAPLPPRSHVPHTGLAPVHITWAPVINSYYACPFF

SEQ ID NO: 6325 - protein, 290 aa, Homo sapiens [sequence omitted]

SEQ ID NO: 6326 - protein, 547 aa, Homo sapiens; identical to SEQ ID NO: 6039

SEQ ID NO: 6327 - protein, 626 aa, Homo sapiens
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 6328 - protein, 626 aa, Homo sapiens; identical to SEQ ID NO: 6327

SEQ ID NO: 6329 - protein, 409 aa, Homo sapiens
MKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTVPSGQ

SEQ ID NO: 6330 - protein, 441 aa, Homo sapiens; identical to SEQ ID NO: 4680

SEQ ID NO: 6331 - protein, 385 aa, Homo sapiens
MASVAAARAVPVGSGLRGLQRTLPLVVILGATGTGKSTLALQLGQRLGGEIVSADSMQPQEMGTEKVIDRKVELEKEDGLVLHKRLSQVDPEMAAKLHPHDKRKVARSLQVFEETGISHSEFLHRQHTEEGGGPLGGPLKFSNPCILWLHADQADERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 6332 - protein, 328 aa, Homo sapiens
MKRPKEPSGSDGESDGPIDVGQEGQLSQMARPLSTPSSSQMQARKKHRGIIEKRRRDRINSSLSELRRLVPTAFEKQGSSKLEKAEVLQMTVDHLKMLHATGGTGFFDARALAVDFRSIGFRECLTEVIRYLGVLEGPSSRADPVRIRLLSHLNSYAAEMEPSPTPTGPLAFPAWPWSFFHSCPGLPALSNQLAILGRVPSPVLPGVSSPAYPIPALRTAPLRRATGIILPARRNVLPSRGASSTRRARPLERPATPVPVAPSSRAARSSHIAPLLQSSSPTPPGPTGSAAYVAVPTPNSSSPGPAGRPAGAMLYHSWVSEITEIGAF

SEQ ID NO: 6333 - protein, 753 aa, Homo sapiens
METFEPISQEPLSQASYDKAPDPVPELQDSFYAELQRAESLQEKSIKEAKTKCRTIASLLTAAPNPHSKGVLMFKKRRQRAKKYTLVSFGAAAGTGAEEEDGVPPTSESELDEEAFSDARSLTNQSDWDSPYLDMELARAGSRASEGQGSGLGGQLSEVSGRGVQLFEQQRQRADSSTQELARVEPAAMLNGEGLQSPPRAQSAPPEAAVLPPSPLPAPVASPRPFQPGGGAPTPAPSIFNRSARPFTPGLQGQRPTTTSVIFRPLAPKRANDSLGGLSPAPPPFLSSQGPTPLPSFTSGVPSHAPVSGSPSTPRSSGPVTATSSLYIPAPSRPVTPGGAPEPPAPPSAAAMTSTASIFLSAPLRPSARPEAPAPGPGAPEPPSAREQRISVPAARTGILQEARRRGTRKQMFRPGKEETKNSPNPELLSLVQNLDEKPRAGGAESGPEEDALSLGAEACNFMQPVGARSYKTLPHVTPKTPPPMAPKTPPPMTPKTPPPVAPKPPSRGLLDGLVNGAASSAGIPEPPRLQGRGGELFAKRQSRADRYVVEGTPGPGLGPRPRSPSPTPSLPPSWKYSPNIRAPPPIAYNPLLSPFFPQAARTLPKAQSQGPRATPKQGIKALDFMRHQPYQLKTAMFCFDEVPPTPGPIASGSPKTARVQEIRRFSTPAPQPTAEPLAPTVLAPRAATTLDEPIWRTELASAPVPSPAPPPEAPRGLGASPSSCGFQVARPRFSATRTGLQAHVWRPGAGHQ

SEQ ID NO: 6334 - protein, 346 aa, Homo sapiens; identical to SEQ ID NO: 4787

SEQ ID NO: 6335 - protein, 522 aa, Homo sapiens
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPL

SEQ ID NO: 6336 - protein, 756 aa, Homo sapiens
MSPQKRVKNVQAQNRTSQGSSSFQTTLSAWKVKQDPSNSKNISKHGQNNPVGDYEHADDQAEEDALQMAVGYFEKGPIKASQNKDKTLEKHLKTVENVAWKNGLASEEIDILLNIALSGKFGNAVNTRILKCMIPATVISEDSVVKAVSWLCVGKCSGSTKVLFYRWLVAMFDFIDRKEQINLLYGFFFASLQDDALCPYVCHLLYLLTKKENVKPFRVRKLLDLQAKMGMQPHLQALLSLYKFFAPALISVSLPVRKKIYFKNSENLWKTALLAVKQRNRGPSPEPLKLMLGPANVRPLKRKWNSLSVIPVLNSSSYTKECGKKEMSLSDCLNRSGSFPLEQLQSFPQLLQNIHCLELPSQMGSVLNNSLLLHYINCVRDEPVLLRFYYWLSQTLQEECIWYKVNNYEHGKEFTNFLDTIIRAECFLQEGFYSCEAFLYKSLPLWDGLCCRSQFLQLVSWIPFSSFSEVKPLLFDHLAQLFFTSTIYFKCSVLQSLKELLQNWLLWLSMDIHMKPVTNSPLETTLGGSMNSVSKLIHYVGWLSTTAMRLESNNTFLLHFILDFYEKVCDIYINYNLPLVVLFPPGIFYSALLSLDTSILNQLCFIMHRYRKNLTAAKKNELVQKTKSEFNFSSKTYQEFNHYLTSMVGCLWTSKPFGKGIYIDPEILEKTGVAEYKNSLNVVHHPSFLSYAVSFLLQESPEERTVNVSSIRGKKWSWYLDYLFSQGLQGLKLFIRSSVHHSSIPRAEGINCNNQY

SEQ ID NO: 6337 - protein, 310 aa, Homo sapiens
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMEDSGAEKENTSVLQQNPSLSGSRNGEENIIDNPYLRPVKKPKIRRKKSLS

SEQ ID NO: 6338 - protein, 644 aa, Homo sapiens
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 6339 - protein, 720 aa, Homo sapiens
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKESMQELLQNFYTTQKLKETLGH

SEQ ID NO: 6340 - protein, 718 aa, Homo sapiens
MSVSGKKEFDVKQILRLRWRWFSHPFQGSTNTGSCLQQEGYEHRGTPVQGRLKSHSRDRNGLKKSNSPVHHNILAPVPGPAPAHQRAVQNLQQHNLIVHFQANEDTPKSVPEKNLFKEACEKRAQDLEMMADDNIEDSTARLDTQHSEDMNATRSEEQFHVINHAEQTLRKMENYLKEKQLCDVLLIAGHLRIPAHRLVLSAVSDYFAAMFTNDVLEAKQEEVRMEGVDPNALNSLVQYAYTGVLQLKEDTIESLLAAACLLQLTQVIDVCSNFLIKQLHPSNCLGIRSFGDAQGCTELLNVAHKYTMEHFIEVIKNQEFLLLPANEISKLLCSDDINVPDEETIFHALMQWVGHDVQNRQGELGMLLSYIRLPLLPPQLLADLETSSMFTGDLECQKLLMEAMKYHLLPERRSMMQSPRTKPRKSTVGALYAVGGMDAMKGTTTIEKYDLRTNSWLHIGTMNGRRLQFGVAVIDNKLYVVGGRDGLKTLNTVECFNPVGKIWTVMPPMSTHRHGLGVATLEGPMYAVGGHDGWSYLNTVERWDPEGRQWNYVASMSTPRSTVGVVALNNKLYAIGGRDGSSCLKSMEYFDPHTNKWSLCAPMSKRRGGVGVATYNGFLYVVGGHDAPASNHCSRLSDCVERYDPKGDSWSTVAPLSVPRDAVAVCPLGDKLYVVGGYDGHTYLNTVESYDAQRNEWKEEVPVNIGRAGACVVVVKLP

SEQ ID NO: 6341 - protein, 377 aa, Homo sapiens
MNGPVSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 6342 - protein, 808 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 6343 - protein, 841 aa, Homo sapiens
MESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTSGSRCSVSAVNLPKHVDSIINKRLSKSSATLWNSPSRNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKQKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 6344 - protein, 164 aa, Homo sapiens
NLPKHVDSIINKRQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 6345 - protein, 114 aa, Homo sapiens
MVIRVYIASSSGSTAIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 6346 - protein, 178 aa, Homo sapiens
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNVCNSVVIL

SEQ ID NO: 6347 - protein, 289 aa, Homo sapiens
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 6348 - protein, 700 aa, Homo sapiens
MTERCSLWSALSAAACCFYRGSFVQFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 6349 - protein, 792 aa, Homo sapiens
MAPALPSPHKAVARPELLLDTAAHSGKLRAPDGGEGAECAGHNGGPSWGVGQGQSQEPSRQGIPQAPWLVSWQRRGFPPSSFCPGPLRTEKLRAGRCPLLLCGGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 6350 - protein, 703 aa, Homo sapiens
MTAVGRRCPALGSRGAAGEPEAGSDYVKFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPTSTSLPRPRDSIRSCALSMDQIPDLHSPMSPISESPSSPAYSTVTRVHAAPAAPSATALPASPVARRSSEPQLCPGSAPKTHGESDKGPHTSPSHTLGKASPSPSLSSYSDPDSGHYCQLQPPVRGSREWAATETSSQQARSYGERLKELSENGAPEGDWGKTFTVPIVEVTSSFNPATFQSLLIPRDNRPLEVGLLRKVKELLAEVDARTLARHVTKVDCLVARILGVTKEMQTLMGVRWGMELLTLPHGRQLRLDLLERFHTMSIMLAVDILGCTGSAEERAALLHKTIQLAAELRGTMGNMFSFAAVMGALDMAQISRLEQTWVTLRQRHTEGAILYEKKLKPFLKSLNEGKEGPPLSNTTFPHVLPLITLLECDSAPPEGPEPWGSTEHGVEVVLAHLEAARTVAHHGGLYHTNAEVKLQGFQARPELLEVFSTEFQMRLLWGSQGASSSQARRYEKFDKVLTALSHKLEPAVRSSEL

SEQ ID NO: 6351 - protein, 622 aa, Homo sapiens
MDQLPQKNLLRLHPAGSAGCSTGVESSSMDGFWMEVEQIQQRDELREEDSGGNEGQLPEEGEAESQWLQDTGLSGLLGGLGLDGDHQELLSTLTQTQVAAVCRRLDIYARSVRRQHKTPVRDVRDVFGVFNSGKMSSENGDSGMKGAQLSSGASKFPPAAEPGGLQEQAGREEAFNMDSAYSEQAAVLLQRSRPSRGGTSAWGKCSLPKFTVPKGRLGVTRIGDLSLQDMRKVPSLALIELTALCDILGLDLKRSKAGKWKAAETRLFGVPLDSLLEADHKVLPSTQVPLVLQALLSCLEKRGLDMEGILRVPGSQARVKGLEQKLERDFYAGLFSWDEVHHNDASDLLKRFIRKLPTPLLTAEYLPAFAVVPNIPNLKQRLQVLHLLILILPEPNRNALKALLEFLRKVVAREQHNKMTLRNVSTVMAPNLFLHQGRPPKLPKGKEKQLAEGAAEVVQIMVHYQDLLWTVASFLVAQVRKLNDSSSRRPQLCDAGLKTWLRRMHADRDKAGDGLEATPKVAKIQVVWPIKDPLKVPLTPSTKVAHVLRQFTEHLSPGSKGQEDSEDMDSLLLHHRSMESANILLYEVGGNINEHRLDPDAYLLDLYRANPHGEWVLKQNPT

SEQ ID NO: 6352 - protein, 281 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGEFSMRQ

SEQ ID NO: 6353 - protein, 309 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 6354 - protein, 210 aa, Homo sapiens
MVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHLPSLACLSKMD

SEQ ID NO: 6355 - protein, 372 aa, Homo sapiens
MKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVC

SEQ ID NO: 6356 - protein, 204 aa, Homo sapiens; identical to SEQ ID NO: 5961

SEQ ID NO: 6357 - protein, 480 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREAPLPPPHIATCAASEPSPPAEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 6358 - protein, 460 aa, Homo sapiens; identical to SEQ ID NO: 5139

SEQ ID NO: 6359 - protein, 835 aa, Homo sapiens
MKRRTDPECTAPIKKQKKRVAELALSLSSTSDDEPPSSVSHGAKASTTSLSGSDSETEGKQHSSDSFDDAFKADSLVEGTSSRYSMYNSVSQKLMAKMGFREGEGLGKYSQGRKDIVEASSQKGRRGLGLTLRGFDQELNVDWRDEPEPSACEQVSWFPECTTEIPDTQEMSDWMVVGKRKMIIEDETEFCGEELLHSVLQCKSVFDVLDGEEMRRARTRANPYEMIRGVFFLNRAAMKMANMDFVFDRMFTNPRDSYGKPLVKDREAELLYFADVCAGPGGFSEYVLWRKKWHAKGFGMTLKGPNDFKLEDFYSASSELFEPYYGEGGIDGDGDITRPENISAFRNFVLDNTDRKGVHFLMADGGFSVEGQENLQEILSKQLLLCQFLMALSIVRTGGHFICKTFDLFTPFSVGLVYLLYCCFERVCLFKPITSRPANSERYVVCKGLKVGIDDVRDYLFAVNIKLNQLRNTDSDVNLVVPLEVIKGDHEFTDYMIRSNESHCSLQIKALAKIHAFVQDTTLSEPRQAEIRKECLRLWGIPDQARVAPSSSDPKSKFFELIQGTEIDIFSYKPTLLTSKTLEKIRPVFDYRCMVSGSEQKFLIGLGKSQIYTWDGRQSDRWIKLDLKTELPRDTLLSVEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 6360 - protein, 83 aa, Homo sapiens
  MOD_RES (1)..(1): Any amino acid
XQELLKEKTLAEQNLEDTRQQLLAARSSQAKAINTLETRVRELEQTLQASEEQLQQSKGIVAAQETQIQELVSAYWSCCIPGP

SEQ ID NO: 6361 - protein, 767 aa, Homo sapiens
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRDHVIASKTGAESKITALEQKEQELQALIQQLSIDLQKVTAETQEKEDVITHLQEKVASLEKRLEQNLSGEEHLQELLKEKTLAEQNLEDTRQQLLAARSSQAKAINTLETRVRELEQTLQASEEQLQQSKGIVAAQETQIQELAAANQESSHVQQQALALEQQFLERTQALEAQIVALERTRAADQTTAEQGMRQLEQENAALKECRNEYERSLQNHQFELKKLKEEWSQREIVSVAMAQALEEVRKQREEFQQQAANLTAIIDEKEQNLREKTEVLLQKEQEILQLERGHNSALLQIHQLQAELEALRTLKAEEAAVVAEQEDLLRLRGPLQAEALSVNESHVTSRAMQDPVFQLPTAGRTPNGEVGAMDLTQLQKEKQDLEQQLLEKNKTIKQMQQRMLELRKTLQKELKIRPDNELFEVREKPGPEMANMAPSVTNNTDLTDAREINFEYLKHVVLKFMSCRESEAFHLIKAVSVLLNFSQEEENMLKETLEYKMSWFGSKPAPKGSIRPSISNPRIPWS

SEQ ID NO: 6362 - protein, 96 aa, Homo sapiens
  MOD_RES (1)..(1): Any amino acid
XAKIKARDLRGKKKEELLKQLDDLKVELSQLRVAKVTGGAASKLSKIRVVRKSIARVLTVINQTQKENLRKFYKAAAGGPCIQMDRVLPQPPACSC

SEQ ID NO: 6363 - protein, 344 aa, Homo sapiens
MRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQI

SEQ ID NO: 6364 - protein, 193 aa, Homo sapiens; identical to SEQ ID NO: 4797

SEQ ID NO: 6365 - protein, 536 aa, Homo sapiens
METMASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 6366 - protein, 922 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 6367 - protein, 408 aa, Homo sapiens
MPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 6368 - protein, 1069 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLESESERERRKTTASPSVRLPQSGSQSSVIPSPPEDDEEEDNDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 6369 - protein, 935 aa, Homo sapiens
MQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGEVKKLNLSASCLMYLFSAAASWLYHY

SEQ ID NO: 6370 - protein, 478 aa, Homo sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATEVLKQQGKLFQVQTEFQMQKTVFPS

SEQ ID NO: 6371 - protein, 1191 aa, Homo sapiens; identical to SEQ ID NO: 5924

SEQ ID NO: 6372 - protein, 522 aa, Homo sapiens
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 6373 - protein, 507 aa, Homo sapiens
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPGKDDFNFNLLVYE

SEQ ID NO: 6374 - protein, 1049 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 6375 - protein, 241 aa, Homo sapiens; identical to SEQ ID NO: 5765

SEQ ID NO: 6376 - protein, 289 aa, Homo sapiens
MIINWNQVSVLWKCLLKQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 6377 - protein, 249 aa, Homo sapiens
MTSVTRSEIIDELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 6378 - protein, 284 aa, Homo sapiens
MTSVTRSEIIDEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 6379 - protein, 356 aa, Homo sapiens
MTSVTRSEIIDEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 6380 - protein, 356 aa, Homo sapiens; identical to SEQ ID NO: 6379

SEQ ID NO: 6381 - protein, 538 aa, Homo sapiens
MAAAASVTGRVTWAASPMRSLGLGRRLSLPGPRLDAVTAAVNPSLSDHGNGLGRGTRGSGCSGGSLVADWGGGAAAAAAVALALAPALSTMRRGSSESELAARWEAEAVAAAKAAAKAEAEATAETVAEQVRVDAGAAGEPECKAGEEQPKVLAPAPAQPSAAEEGNTQVLQRPPPTLPPSKPKPVQGLCPHGKPRDKGRSCKRSSGHGSGENGSQRPVTVDSSKARTSLDALKISIRQLKWKEFPFGRRLPCDIYWHGVSFHDNDIFSGQVNKFPGMTEMVRKITLSRAVRTMQNLFPEEYNFYPRSWILPDEFQLFVAQVQMVKDDDPSWKPTFIVKPDGGCQGDGIYLIKDPSDIRLAGTLQSRPAVVQEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQVTIASSQPAFPALTGLKRALWLRVG

SEQ ID NO: 6382 - protein, 451 aa, Homo sapiens
MTEMVRKITLSRAVRTMQNLFPEEYICKPLLIDKLKFDIRLYVLLKSLDPLEIYIAKDGLSRFCTEPYQEPTPKNLHRIFMHLTNYSLNIHSGNFIHSDSASTGSKRTFSSILCRLSSKGVDIKKVWSDIISVVIKTVIALTPELKVFYQSDIPTGRPGPTCFQILGFDILLMKNLKPILLEVNANPSMRIEHEHELSPGVFENVPSLVDEEVKVAVIRDTLRLMDPLKKKRENQSQQLEKPFAGKEDALDGELTSAPDCNANPEAHLPSICLKQVFPKYAKQFNYLRLVDRMANLFIRFLGIKGTMKLGPTGFRTFIRSCKLSSSSLSMAAVDILYIDITRRWNSMTLDQRDSGMCLQAFVEAFFFLAQRKFKMLPLHEQVASLIDLCEYHLSLLDEKRLVCGRGVPSGGRPPHRGPPQEPSPSAQPAGDNPPPRTSCANKLSHPRHTLS

SEQ ID NO: 6383 - protein, 547 aa, Homo sapiens
MKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWHKHFTEDIQTRQYRSLEVLIGSGYNTPADIWSTACMAFELATGDYLFEPHSGEEYTRDEDHIVHIIELIGRIPRRFSLSGKYSQDFFSHRGDLKHITKLKPWGLFEVLVEKYEWSQEEAAGFTDFLLPMLELIPEKRATAAECLRHPWLNS

SEQ ID NO: 6384 - protein, 655 aa, Homo sapiens
MERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 6385 - protein, 287 aa, Homo sapiens
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 6386 - protein, 145 aa, Homo sapiens
MAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTAFLQ

SEQ ID NO: 6387 - protein, 1007 aa, Homo sapiens
MQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKVCLLVVWGVSSVWTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 6388 - protein, 994 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEE

SEQ ID NO: 6389 - protein, 1773 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 6390 - protein, 828 aa, Homo sapiens
MEKQKQEIAGKQKEIKDLQIAIDSLDSKDPKHSHMKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLVSGKTYNSLSTLLPWVTDKVIYLMS

SEQ ID NO: 6391 - protein, 2325 aa, Homo sapiens; identical to SEQ ID NO: 4770

SEQ ID NO: 6392 - protein, 452 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDHKLDYQNCMMK

SEQ ID NO: 6393 - protein, 350 aa, Homo sapiens
MCCDSDFVARNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSVGTVAEITGHQLMSLSTANAKKDPSCKTCNISVGR

SEQ ID NO: 6394 - protein, 376 aa, Homo sapiens
MEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSVGTVAEITGHQLMSLSTANAKKDPSCKTCNISVGR

SEQ ID NO: 6395 - protein, 420 aa, Homo sapiens; identical to SEQ ID NO: 5350

SEQ ID NO: 6396 - protein, 136 aa, Homo sapiens
DPLSWLSGPWGQVPAGICPPRHRGWYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQ

SEQ ID NO: 6397 - protein, 454 aa, Homo sapiens
MERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQWDFASYDILRVIKTPEIANLALLGFGDIFALLFDNRYLYIMDLRTESLISRWPLPEYRKSKRGSSFLAGEASWLNGLDGHNDTGLVFATSMPDHSIHLVLWKEHG

SEQ ID NO: 6398 - protein, 123 aa, Homo sapiens
MEAAETEAEAAALEVLAEVAGILEPVGLQEEAELPAKILVEFVVDSQKKDKLLCSQLQVADFLQNILAQERPWCVLQGCWSTTCWRCKFAMTSWRTAAWRKILEKASDFPHLPTIITGKTVNS

SEQ ID NO: 6399 - protein, 277 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 6400 - protein, 570 aa, Homo sapiens
MSSIGEGIDFSQERQKISGLRTLEQSVGEWLESIGLQQYESKLLLNGFDDVHFLGSNVMEEQDLRDIGISDPQHRRKLLQAARSLPKVKALGYDGNSPPSVPSWLDSLGLQDYVHSFLSSGYSSIDTVKNLWELELVNVLKVQLLGHRKRIIASLADRPYEEPPQKPPRFSQLRCQDLLSQTSSPLSQNDSCTGRSADLLLPPGDTGRRRHDSLHDPAAPSRAERFRIQEEHREAKLTLRPPSLAAPYAPVQSWQHQPEKLIFESCGYEANYLGSMLIKDLRGTESTQDACAKMRKSTEHMKKIPTIILSITYKGVKFIDASNKNVIAEHEIRNISCAAQDPEDLCTFAYITKDLQTSHHYCHVFSTVDVNLTYEIILTLGQAFEVAYQLALQAQKSRATGASAAEMIETKSSKPVPKPRVGVRKSAVPLPPDSRCCYCHTCTTHRPSYLPLPSVSPGVKLEPPDMDQDAQSHASVSWVVDPKPDSKRSLSTNHTRLELVCCSQPENELVSTISGDKPKSFLEPLLFVMPTTAYNHNCPEWRSQKDGGCSTSECPHHLCLEKPGVLSLEM

SEQ ID NO: 6401 - protein, 594 aa, Homo sapiens; identical to SEQ ID NO: 5068

SEQ ID NO: 6402 - protein, 594 aa, Homo sapiens
MEAVCLGTCPEPEASMSTAIPGLKKGNNALQSIILQTLLEKENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 6403 - protein, 586 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 6404 - protein, 586 aa, Homo sapiens; identical to SEQ ID NO: 6403

SEQ ID NO: 6405 - protein, 513 aa, Homo sapiens
MQRTFAWLLDRVQHLGAPVTLRASYLEIYNEQVRDLLSLGSPRPLPVRWNKTRGFYVEQLRVVEFGSLEALMELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQVLDPEASGGRPPSARPPPWAPPCSPGSAKCPRERSHSDWTQTRVLAEMLTEEEVVPSAPPLPVRPPKTSPGLRGGAGVPNLAQRLEALRDQIGSSLRRGRSQPPCSEGARSPGQVLPPH

SEQ ID NO: 6406 - protein, 261 aa, Homo sapiens
MVKGEKGPKGKKITLKVARNCIKITFDGKKRLDLSKMGITTFPKCILRLSDMDELDLSRNLIRKIPDSISKFQNLRWLDLHSNYIDKLPESIGQMTSLLYLNVSNNRLTSNGLPVELKQLKNIRAVNLGLNHLDSVPTTLGALKELHEVGLHDNLLNNIPVSISKLPKLKKLNIKRNPFPKPGESEIFIDSIRRLENLYVVEEKDLCAACLRKCQNARDNLNRIKNMATTTPRKTIFPNLISPNSMAKDSWEDWRIRLTSS

SEQ ID NO: 6407 - protein, 589 aa, Homo sapiens
MASSQRDMEDWVQAIRRVIWAPLGGGTARRSHAHPLEPLPPGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 6408 - protein, 402 aa, Homo sapiens
MSAEGAEPGPGSGSGPGPGPLCPEHGQALSWFCGSERRPVCAACAGLGGRCRGHRIRRAEERAEELRNKIVDQCERLQLQSAAITKYVADVLPGKNQRAVSMASAARELVIQRLSLVRSLCESEEQRLLEQVHGEEERAHQSILTQRVHWAEALQKLDTIRTGLVGMLTHLDDLQLIQKEQEIFERTEEAEGILDPQESEMLNFNEKCTRSPLLTQLWATAVLGSLSGTEDIRIDERTVSPFLQLSDDRKTLTFSTKKSKACADGPERFDHWPNALAATSFQNGLHAWMVNVQNSCAYKVGVASGHLPRKGSGSDCRLGHNAFSWVFSRYDQEFRFSHNGQHEPLGLLRGPAQLGVVLDLQVQELLFYEPASGTVLCAHHVSFPGPLFPVFAVADQTISIVR

SEQ ID NO: 6409 - protein, 85 aa, Homo sapiens
MLRRKPTRLELKLDDIEEFENIRKDLETRKKQKEDVEVVGGSDGEGAIGLSSDPKSREQMINDRIGYKPQPKPNNRSSQFGSLEF

SEQ ID NO: 6410 - protein, 247 aa, Homo sapiens
MLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKV

SEQ ID NO: 6411 - protein, 487 aa, Homo sapiens; identical to SEQ ID NO: 5916

SEQ ID NO: 6412 - protein, 339 aa, Homo sapiens; identical to SEQ ID NO: 5550

SEQ ID NO: 6413 - protein, 520 aa, Homo sapiens
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 6414 - protein, 520 aa, Homo sapiens; identical to SEQ ID NO: 6413

SEQ ID NO: 6415 - protein, 277 aa, Homo sapiens
MFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 6416 - protein, 437 aa, Homo sapiens
MAGGPPKALPSTGPHSLRDMPHPLAGSSSEEAVGGDSTPSPDLLMARSFGDKDLILPNGGTPAGTSSPASSSSLLNRLQLDDDIDGETRDLFVIVDDPKKHVCTMETYITYRITTKSTRVEFDLPEYSVRRRYQDFDWLRSKLEESQPTHLIPPLPEKFVVKGVVDRFSEEFVETRRKALDKFLKRITDHPVLSFNEHFNIFLTAKDLNAYKKQGIALLTRMGESVKHVTGGYKLRTRPLEFAAIGDYLDTFALKLGTIDRIAQRIIKEEIEYLVELREYGPVYSTWSALEGELAEPLEGVSACIGNCSTALEELTDDMTEDFLPVLREYILYSDSMKSVLKKRDQVQAEYEAKLEAVALRKEDRPKVPADVEKCQDRMECFNADLKADMERWQNNKRQDFRQLLMGMADKNIQYYEKCLMAWESIIPLLQEKQEAK

SEQ ID NO: 6417 - protein, 420 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 6418 - protein, 278 aa, Homo sapiens [sequence omitted]

SEQ ID NO: 6419 - protein, 226 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 6420 - protein, 226 aa, Homo sapiens
MHQTCVRLEREASARPSPGPVLPPRPLPSHTELQIREGPKRTIRAAAEGAPCVGRVRCAPGNRGGREGASGVRGGVAQVPPRLPAPPIGPERDDLAGGAGRKPLPSTAAASSPGSAAAATAALCPPARLSTPSMSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 6421 - protein, 505 aa, Homo sapiens
MDPGNENSATEAAAIIDLDPDFEPQSRPRSCTWPLPRPEIANQPSEPPEVEPDLGEKVHTEGRSEPILLPSRLPEPAGGPQPGILGAVTGPRKGGSRRNAWGNQSYAELISQAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 6422 - protein, 353 aa, Homo sapiens
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTDEEEEEFIEEEDQEEEESTEGKEEGHQ

SEQ ID NO: 6423 - protein, 392 aa, Homo sapiens
MGVNQSVGFPPVTGPHLVGCGDVMEGQNLQGSFFRLFYPCQKAEETMEQPLWIPRYEYCTGLAEYLQFNKRCGGLLFNLAVGSCRLPVSWNGPFKTKDSGYPLIIFSHGLGAFRTLYSAFCMELASRGFVVAVPEHRDRSAATTYFCKQAPEENQPTNESLQEEWIPFRRVEEGEKEFHVRNPQVHQRVSECLRVLKILQEVTAGQTVFNILPGGLDLMTLKGNIDMSRVAVMGHSFGGATAILALAKETQFRCAVALDAWMFPLERDFYPKARGPVFFINTEKFQTMESVNLMKKICAQHEQSRIITVLGSVHRSQTDFAFVTGNLIGKFFSTETRGSLDPYEGQEVMVRAMLAFLQKHLDLKEDYNQWNNLIEGIGPSLTPGAPHHLSSL

SEQ ID NO: 6424 - protein, 392 aa, Homo sapiens; identical to SEQ ID NO: 6423

SEQ ID NO: 6425 - protein, 70 aa, Homo sapiens
MVRTKTWTLKKHFVGYPTNSDFELKTAELPPLKNGEVLLEALFLTVDPYMRVAAKRLKEGDTMMGQQVAK

SEQ ID NO: 6426 - protein, 70 aa, Homo sapiens; identical to SEQ ID NO: 6425

SEQ ID NO: 6427 - protein, 177 aa, Homo sapiens; identical to SEQ ID NO: 4768

SEQ ID NO: 6428 - protein, 420 aa, Homo sapiens; identical to SEQ ID NO: 6417

SEQ ID NO: 6429 - protein, 278 aa, Homo sapiens [sequence omitted]

SEQ ID NO: 6430 - protein, 226 aa, Homo sapiens; identical to SEQ ID NO: 6419

SEQ ID NO: 6431 - protein, 262 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDRFKHRNRSFSRSKSNSRSRSKSQPKKEMKAKSRSRSASHTKTRGTSKTDSKTHYKSGSRYEKESRKKEPPRSKSQSRSQSRSRSKSRSRSWTSPKSSGH

SEQ ID NO: 6432 - protein, 173 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYSSSRYDDYDRYRRSRSRSYERRRSRSRSFDYNYRRSYSPRNSRPTGRPRRSRSHSDNDSQVSKKKNER

SEQ ID NO: 6433 - protein, 222 aa, Homo sapiens
MSAFGHDEAWMEAGGFGLEAAERTEYQSLCKSKLLFLGEQSVGKTSIISRFMYNSFGCACQATVGIDFLSKTMYLEDQIVQLQLWDTAGQERFHSLIPSYIRDSTIAVVVYDITNINSFKETDKWVEHVRAERGDDVVIMLLGNKIDLDNKRQVTAEQGEEKSRNLNVMFIETSAKTGYNVKKLFRRVASALLSTRTSPPPKEGTVEIELESFEESGNRSYC

SEQ ID NO: 6434 - protein, 115 aa, Homo sapiens
MVQIIKDTNEFKTFLTAAGHKLAVVQFSSKRCGPCKRMFPVFHAMSVKYQNVFFANVDVNNSPELAETCHIKTIPTFQMFKKSQKVTLFSRIKRIICCYRSGFMSNLCLADDGNE

SEQ ID NO: 6435 - protein, 127 aa, Homo sapiens
MVQIIKDTNEFKTFLTAAGHKLAVVQFSSKRCGPCKRMFPVFHAMSVKYQNVFFANVDVNNSPELAETCHIKTIPTFQMFKKSQKVTLFSRIKRIICCYRSGFMSNLIFEFCGADAKKLEAKTQELM

SEQ ID NO: 6436 - protein, 588 aa, Homo sapiens
MHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 6437 - protein, 203 aa, Homo sapiens
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPAWNLGIPAKPHPTLKRASESPQAPPDPA

SEQ ID NO: 6438 - protein, 643 aa, Homo sapiens; identical to SEQ ID NO: 6047

SEQ ID NO: 6439 - protein, 455 aa, Homo sapiens
MGQESSKPVWPNPTGGYQSNTGRRYGRRHAYVSFRPPTSQRERIASQRKTNSEVPMHRSAPSQTTKRSRSPFSTTRRSWDDSESSGTNLNIDNEDYSSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 6440 - protein, 129 aa, Homo sapiens
MAELIQKKLQGEVEKYQQLQKDLSKSMSGRQKLEAQLTENNIVKEELALLDGSNVVFKLLGPVLVKQELGEARATVGKRLDYITAEIKRYESQLRDLERQSEQQRETLAQLQQEFQRAQAAKAGAPGKA

SEQ ID NO: 6441 - protein, 129 aa, Homo sapiens; identical to SEQ ID NO: 6440

SEQ ID NO: 6442 - protein, 129 aa, Homo sapiens; identical to SEQ ID NO: 6440

SEQ ID NO: 6443 - protein, 503 aa, Homo sapiens
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGKVLISWWCTPVITATQEAAARESLEPGRQRLQRDKIAPLDSSLGGGGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 6444 - protein, 115 aa, Homo sapiens
MATEPEAAEPVVPSLVDRYFTRWYKPDVKGKFCEDHCILQHSNRICVITLAESHPVLQSGKTIKSISYQISTNCSRLQNKVSGKFKRRIIYLEKVEDVIKRKMMPLSLGLHLPHS

SEQ ID NO: 6445 - protein, 521 aa, Homo sapiens
MNVSLSQKTVKIHRLFPMLAFSEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQIMHAFSVAPFDQNLSIDGKILSDDCATLGTLGVIPESVILLKADEPIADYAAMDDVMQVCMPEEGFKGTGLLGH

SEQ ID NO: 6446 - protein, 327 aa, Homo sapiens
MTAVGAERLTSVRAWLSCCGACVCVFLFLCLCVFPLRVHVHVWGGECRVDIAVFVSKHMIVALMHVTGAAGLLRLCVRACVCMRVCATAHMYRVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKVWLDLGTAH

SEQ ID NO: 6447 - protein, 692 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLSLIVPGKSPTRKKSGPFGSRRSSAIGIENIQEVQEKRESPPAGQKTPDSGHVSQEPKSENSSTQSSPEMPTTKNRAETAAQRAEALKLPLLVQCQQLRQRGGGDGGCGRRGHRPGERVILRNTPQAGLLHL

SEQ ID NO: 6448 - protein, 694 aa, Homo sapiens
MAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 6449 - protein, 693 aa, Homo sapiens
MAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 6450 - protein, 663 aa, Homo sapiens
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 6451 - protein, 247 aa, Homo sapiens
MLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAVRESVNYLVSQQNMLLIPTSFSPLK

SEQ ID NO: 6452 - protein, 1197 aa, Homo sapiens; identical to SEQ ID NO: 5099

SEQ ID NO: 6453 - protein, 1197 aa, Homo sapiens; identical to SEQ ID NO: 5099

SEQ ID NO: 6454 - protein, 348 aa, Homo sapiens
MSLPRFQRVNFGPYDNYIPVSELSKKSWNQQHFALLFPKPQRPGTKRRSKPSQIRDNTVSIIDEEQLRGDRRQPLWMYRSLMRISERPSVYLAARRQPLKPTRTVEVDSKAAEIGKKGEDKTTQKDTTDSESELKQGKKDSKKGKDIEKGKEEKLDAKKDSKKGKKDAEKGKDSATESEDEKGGAKKDNKKDKKDSNKGKDSATESEGEKGGTEKDSKKGKKDSKKGKDSAIELQAVKADEKKDEDGKKDANKGDESKDAKKDAKEIKKGKKDKKKPSSTDSDSKDDVKKESKKDATKDAKKVAKKDTEKESADSKKDAKKNAKKDAKKDAKKNAKKDEKKDAKKKGK

SEQ ID NO: 6455 - protein, 504 aa, Homo sapiens
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNEC

SEQ ID NO: 6456 - protein, 247 aa, Homo sapiens
MLKFLVWFLQWCVCVLVQPAKELLHCLKMQMRISKYTKCLQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPVSASSLQLT

SEQ ID NO: 6457 - protein, 1305 aa, Homo sapiens
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 6458 - protein, 1591 aa, Homo sapiens
MNSQPQTRSPGGFRPIQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 6459 - protein, 333 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 6460 - protein, 872 aa, Homo sapiens
MGEGGLPPAFQLLLRACDQGDTETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAARFGHVSVAHLLLDHGADVNAQNRLGASVLTVASRGGHLGVVKLLLEAGAFVDHHHPSGEQLGLGGSRDEPLDITALMAAIQHGHEAVVRLLMEWGADPNHAARTVGWSPLMLAALTGRLGVAQQLVEKGANPDHLSVLEKTAFEVALDCKHRDLVDYLDPLTTVRPKTDEEKRRPDIFHALKMGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPQRASRGHPVGGGGTDTTPVRPVKFPSLPRSPASSANSGNFNHSPHSSGGSSGVGVSRHGGELLNRSGGSIDNVLSQIAAQRKKAAGLLEQKPSHRSSPVGPAPGSSPSELPASPAGGSAPVGKQKLETSKRPPSGTSTTSKSTSPTLTPSPSPKGHTAESSVSSSSSHRQSKSSGGSSSGTITDEDELTGILKKLSLEKYQPIFEEQEVDMEAFLTLTDGDLKELGIKTDGSRQQILAAISELNAGKGRERQILQETIHNFHSSFESSASNTRAPGNSPCA

SEQ ID NO: 6461 - protein, 160 aa, Homo sapiens
MEAERPQEEEDGEQGPPQDEEGWPPPNSTTRPWRSAPPSPPPPGTRHTALGPRSASLLSLQTELLLDLVAEAQSRRLEEQRATFYTPQNPSSLAPAPLRPLEDREQLYSTILSHQCQRMEAQRSEPPLPPGGQELLELLLRVQGGGRMEEQRSRPPTHTC

SEQ ID NO: 6462 - protein, 160 aa, Homo sapiens; identical to SEQ ID NO: 6461

SEQ ID NO: 6463 - protein, 929 aa, Homo sapiens
MQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDVEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVAVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 6464 - protein, 141 aa, Homo sapiens
MNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQVCGELRLGNNTILSHKDFSLKKILVKFVRRLYSTC

SEQ ID NO: 6465 - protein, 790 aa, Homo sapiens
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 6466 - protein, 232 aa, Homo sapiens
MSQVLSILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 6467 - protein, 800 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHSIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 6468 - protein, 356 aa, Homo sapiens
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAASRRASGVGAQG

SEQ ID NO: 6469 - protein, 841 aa, Homo sapiens
MGARAAGTSSGGGPRPCLARGLSASPFPAKQQHPQAGASPAELQQRAYYRARQDAASQPGLGFLISPSSCSSWGPGSFTRSCGYPTLCSSWISKREPGELSGVWTSAWRTHAAFTGSQDLCLYKGLGSIYEDKTALSLLGLGEETNEEDEEESDNQSVHSSSEPLRNLHLDIGALGGDFEYEESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERYHRLSPPLPHEERAQSPPRSLATEEEPPQGPEGQPEWKEAEELGEDSAASLSLQLSLQRRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQVRDLQESLTSES

SEQ ID NO: 6470 - protein, 350 aa, Homo sapiens
MIRGFEAPMAENPPPPPPPVIFCHDSPKRVLVSVIRTTPIKPTCGGGGEPEPPPPLIPTSPGFSDFMVYPWRWGENAHNVTLSPGAAGAAASAALPAAAAAEHSGLRGRGAPPPAASASAAASGGEDEEEASSPDSGHLKDGIRRGRPRADTVRDLINEGEHSSSRIRCNICNRVFPREKSLQAHKRTHTGERPYLCDYPDCGKAFVQSGQLKTHQRLHTGEKPFVCSENGCLSRFTHANRHCPKHPYARLKREEPTDTLSKHQAADNKAAAEWLARYWEMREQRTPTLKGKLVQKADQEQQDPLEYLQSDEEDDEKRGAQRRLQEQRERLHGALALIELANLTGAPLRQ

SEQ ID NO: 6471 - protein, 378 aa, Homo sapiens
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRMQGVVNRLSKLLKPGGMLLFRDYGRYDKTQLRFKKGHCLSENFYVRGDGTRAYFFTKGEVHSMFCKASLDEKQNLVDRRLQVNRKKQVKMH

SEQ ID NO: 6472 - protein, 598 aa, Homo sapiens
MGLRASRPSKLTWKKWATTAASNSCSRSVSSCRRCTGGRLMKEPWRRPSSSICYTSRSSTIKFSSNKFKTLSVLLSHLHLFRLHVKISQPSLPISSRGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 6473 - protein, 1321 aa, Homo sapiens
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 6474 - protein, 522 aa, Homo sapiens
MPRKKAAAAAWEEPSSGNGTARAGPRKRGGPAGRKRERPERCSSSSGGGSSGDEDGLELDGAPGGGKRAARPATAGKAGGAAVVITEPEHTKERVKLEGSKCKGQLLIFGATNWDLIGRKEVPKQQAAYRNLGQNLWGPHRYGCLAGVRVRTVVSGSCAAHSLLITTEGKLWSWGRNEKGQLGHGDTKRVEAPRLIEGLSHEVIVSAACGRNHTLALTETGSVFAFGENKMGQLGLGNQTDAVPSPAQIMYNGQPITKMACGAEFSMIMDCKGNLYSFGCPEYGQLGHNSDGKFIARAQRIEYDCELVPRRVAIFIEKTKDGQILPVPNVVVRDVACGANHTLVLDSQKRVFSWGFGGYGRLGHAEQKDEMVPRLVKLFDFPGRGASQIYAGYTCSFAVSEVGGLFFWGATNTSRESTMYPKAVQDLCGWRIRSLACGKSSIIVAADESTISWGPSPTFGELGYGDHKPKSSTAAQEVKTLDGIFSEQVAMGYSHSLVIARDESETEKEKIKKLPEYNPRTL

SEQ ID NO: 6475 - protein, 522 aa, Homo sapiens; identical to SEQ ID NO: 6474

SEQ ID NO: 6476 - protein, 183 aa, Homo sapiens
MTDQTYCDRLVQDTPFLTGHGRLSEQQVDRIILQLNRYYPQILTNKEAEKFRNPKASLRVRLCDLLSHLQRSGERDCQEFYRALYIHAQPLHSRLPSRHALQNSDCTELDSGSQSGELSNRGPMSFLAGLGLAVGLALLLYCYPPDPKGLPGTRRVLGFSPVIIDRHVSRYLLAFLADDLGGL

SEQ ID NO: 6477 - protein, 163 aa, Homo sapiens
MLDLLDIEGLYPLYNRVERYLEEFPEERKTLQIDGPYDEAFYQKLLDLSTEDDGTVAFALTKVQQYRVAMTAKDCSIMIALSPCLQDASSDQRPVVPSSRSRFAFSVSVLDLDLKPYESIPHQYKLDGKIVNYYSKTVRAKDNAVMSTRFKESEDCTLVLHKV

SEQ ID NO: 6478 - protein, 258 aa, Homo sapiens
MARPPVPGSVVVPNWHESAEGKEYLACILRKNRRRVFGLLERPVLLPPVSIDTASYKIFVSGKSGVGKTALVAKLAGLEVPVVHHETTGIQTTVVFWPAKLQASSRVVMFRFEFWDCGESALKKFDHMLLACMENTDAFLFLFSFTDRASFEDLPGQLARIAGEAPGVVRMVIGSKFDQYMHTDVPERDLTAFRQAWELPLLRVKSVPGRRLADGRTLDGRAGLADVAHILNGLAEQLWHQDQVAAGLLPNPPESAPE

SEQ ID NO: 6479 - protein, 110 aa, Homo sapiens
MADKVLKEKRKQFIRSVGEGTINGLLGELLETRVLSQEEIEIVKCENATVMDKARALLDSVIRKGAPACQICITYICEEDSHLAGTLGLSAGPTSGNHLTTQDSQIVLPS

SEQ ID NO: 6480 - protein, 307 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPARSEFFN

SEQ ID NO: 6481 - protein, 1019 aa, Homo sapiens
MEPGEVKDRILENISLSVKKLQSYFAACEDEIPAIRNHDKVLQRLCEHLDHALLYGLQDLSSGYWVLVVHFTRREAIKQIEVLQHVATNLGRSRAWLYLALNENSLESYLRLFQENLGLLHKYYVKNALVCSHDHLTLFLTLVSGLEFIRFELDLDAPYLDLAPYMPDYYKPQYLLDFEDRLPSSVHGSDSLSLNSFNSVTSTNLEWDDSAIAPSSEDYDFGDVFPAVPSVPSTDWEDGDLTDTVSGPRSTASDLTSSKASTRSPTQRQNPFNEEPAETVSSSDTTPVHTTSQEKEEAQALDPPDACTELEVIRVTKKKKIGKKKKSRSDEEASPLHPACSQKKCAKQGDGDSRNGSPSLGRDSPDTMLASPQEEGEGPSSTTESSERSEPGLLIPEMKDTSMERLGQPLSKVIDQLNGQLDPSTWCSRAEPPDQSFRTGSPGDAPERPPLCDFSEGLSAPMDFYRFTVESPSTVTSGGGHHDPAGLGQPLHVPSSPEAAGQEEEGGGGEGQTPRPLEDTTREAQELEAQLSLVREGPVSEPEPGTQEVLCQLKRDQPSPCLSSAEDSGVDEGQGSPSEMVHSSEFRVDNNHLLLLMIHVFRENEEQLFKMIRMSTGHMEGNLQLLYVLLTDCYVYLLRKGATEKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 6482 - protein, 105 aa, Homo sapiens
MKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTRSNSY

SEQ ID NO: 6483 - protein, 105 aa, Homo sapiens; identical to SEQ ID NO: 6482

SEQ ID NO: 6484 - protein, 594 aa, Homo sapiens
MLPRTKYNRFRNDSVTSVDDLLHSLSVSGGGGKVSAARATPAAAPYLVSGEALRKAPDDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVAKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTIRTKDRVFDSISHLINHHLESSLPIVSAGSELCLQQPVERKQ

SEQ ID NO: 6485 - protein, 230 aa, Homo sapiens
MNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKVAPGGQCVPITDSQQPGRL

SEQ ID NO: 6486 - protein, 355 aa, Homo sapiens
MNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEARLRQRSEETTEAALLLPSSSEESFQLIPSCQEEISLSRPCV

SEQ ID NO: 6487 - protein, 279 aa, Homo sapiens
MSRPKNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSMFTSPTWLCKKHLPTTTQRRAASGRCSASGSTWRPNTGPRQWRHSSGTSTTSLSKACRVCRR

SEQ ID NO: 6488 - protein, 371 aa, Homo sapiens
MSRPKNQNYKGHGLSKGKEREQRASIRFKTTLMNTLMDVLRHRPGWVEVKDEGEWDFYWCDVSWLRENLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSYIPLRAWLYRDGFARFSNTRFTLNSIDDQYVHLTNVAVQKTSPDYHPKKLHPTVGPLCIHSPENGSLSVTPWPWDAHMGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEASFSPIIPAEV

SEQ ID NO: 6489 - protein, 439 aa, Homo sapiens
MVPSREALLGPGTTAIRCPKKLQNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSVFAECLLWSGHRRQDVHLTNVAVQKTSPDYHPKKGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEARLTGREKRVGGFDLMWNDGPVSREEGAPDLSGMGNFVTNTHLGCVNDRKKQLRQLFCSLQVQKKASS

SEQ ID NO: 6490 - protein, 166 aa, Homo sapiens
MKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSL

SEQ ID NO: 6491 - protein, 775 aa, Homo sapiens
MMEDNKQLALRIDGAVQSASQEVTNLRAELTATNRRLAELSGGGGPGPGPGAAASASAAGDSAATNMENPQLGAQVLLREEVSRLQEEVHLLRQMKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDDSDSQCSPTRQSLSLSEGEEQMDRLQQVELVRTTPMSHWKAGTVQAWLEVVMAMPMYVKACTENVKSGKVLLSLSDEDLQLGLGVCSSLHRRKLRLAIEDYRDAEAGRSLSKAAELDHHWVAKAWLNDIGLSQYSQAFQNHLVDGRMLNSLMKRDLEKHLNVSKKFHQVSILLGIELLYQVNFSREALQERRARCETQNIDPVVWTNQRVLKWVRDIDLKEYADNLTNSGVHGAVLVLEPTFNAEAMATALGIPSGKHILRRHLAEEMSAVFHPANSTGIREAERFGTPPGRASSVTRAGKEENSSGLKYKAGRLPLGKIGRGFSSKDPDFHDDYGSLQNEDCGDDDPQSRLEQCRLEGYNSLEVTNV

SEQ ID NO: 6492 - protein, 286 aa, Homo sapiens
MYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKVILSYIPAKYNMKC

SEQ ID NO: 6493 - protein, 553 aa, Homo sapiens
MNKNTSTVVSPSLLEKDPAFQMITIAKETGLGLKVLGGINRNEGPLVYIQEIIPGGDCYKDGRLKPGDQLVSVNKESMIGVSFEEAKSIITGAKLRLESAWEIAFIRQKSDNIQPENLSCTSLIEASGEYGPQASTLSLFSSPPEILIPKTSSTPKTNNDILSSCEIKTGYNKTVQIPITSENSTVGLSNTDVASAWTENYGLQEKISLNPSVRFKAEKLEMALNYLGIQPTKEQHQALRQQVQADSKGTVSFGDFVQVARNLFCLQLDEVNVGAHEISNILDSQLLPCDSSEADEMERLKCERDDALKEVNTLKEKLLESDKQRKQLTEELQNVKQEAKAVVEETRALRSRIHLAEAAQRQAHGMEMDYEEVIRLLEAKITELKAQLADYSDQNKESVQDLKKRIMVLDCQLRKSEMARKTFEASTEKLLHFVEAIQEVFSDNSTPLSNLSERRAVLASQTSLTPLGRNGRSIPATLALESKELVKSVRALLDMDCLPYGWEEAYTADGIKYFINHVTQTTSWIHPVMSVLNLSRSEENEEDCSRELPNQKS

SEQ ID NO: 6494 - protein, 187 aa, Homo sapiens
MAAPGALLVMGVSGSGKSTVGALLASELGWKFYDADDYHPEENRRKMGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 6495 - protein, 377 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLIMSLAGKGNQHLVTCFPHPVSGGRANCPISTLIQSPWCGWG

SEQ ID NO: 6496 - protein, 740 aa, Homo sapiens
MEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPREEQVSTLYQNINLVEPRLIQPYEHVIKNFIREIRLQSTEMENLAIAVKRAQDKAAMQLSELEEEMDQRIQAAEHKTRKDEKRKAEEALSDLRRQYETEVGDLQVTIKKLRKLEEQSKRVSQKEDVAALKKQIYDLSMENQKVKKDLLEAQTNIAFLQSELDALKSDYADQSLNTERDLEIIRAYTEDRNSLERQIEILQTANRKLHDSNDGLRSALENSYSKFNRSLHINNISPGNTISRSSPKFIGHSPQPLGYDRSSRSSYVDEDCDSLALCDPLQRTNCEVDSLPESCFDSGLSTLRDPNEYDSEVEYKHQRGFQRSHGVQESFGGDASDTDVPDIRDEETFGLEDVASVLDWKPQGSVSEGSIVSSSRKPISALSPQTDLVDDNAKSFSSQKAYKIVLAGDAAVGKSSFLMRLCKNEFRENISATLGVDFQMKTLIVDGERTVLQLWDTAGQERFRSIAKSYFRKADGVLLLYDVTCEKSFLNIREWVDMIEDAAHETVPIMLVGNKADIRDTAATEGQKCVPGHFGEKLAMTYGALFCETSAKDGSNIVEAVLHLAREVKKRTDKDDSRSITNLTGTNSKKSPQMKNCCNG

SEQ ID NO: 6497 - protein, 1374 aa, Homo sapiens
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 6498 - protein, 1943 aa, Homo sapiens
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 6499 - protein, 1264 aa, Homo sapiens
MQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 6500 - protein, 176 aa, Homo sapiens
MGCCGCSGGCGSGCGGCGSGSGGCGSGCGGCGSSCCVPICCCKPVCCCVPACSCSSCGSCGGSKGGCGSCGSSKGGCGSCGCSQSNCCKPCCSSSGCGSFCCQSSCSKPCCCQSSCCQSSCCKPCCCQSSCCQSSCFKPCCCQSSCCVPVCCQSSCCKPCCSQSSCCVPICCQYKI

SEQ ID NO: 6501 - protein, 170 aa, Homo sapiens
MGCCGCSGGCGSGCGGCGSGCGGCGSGCGGYGSGCGGCGSSCCVPVCCCKPVCCCVPACSCSSCGSCGGSKGDCGCGSCGGSKGGCGSCGCSQCNCCKPCCCSSGCGSCCQSSCCNPCCCQSSCCVPVCCQSSCCKPCCCQSSCCVPSSCCRSCCSKSSCCVPICCQYKI

SEQ ID NO: 6502 - protein, 722 aa, Homo sapiens
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIVGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQVSICMQSAYNEGTLMKFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 6503 - protein, 373 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIDNSEIISRNGMECQESALRITKHCYCTYYPVSSSIELPQTAC

SEQ ID NO: 6504 - protein, 106 aa, Homo sapiens
MTQSTAKAMKRPLEATVDLAFPPGALHPLPKRQALEKSNGTSAVFNPSVLHYQQALTSAQLQQHAAFIPTVPMMHSATSATVSAATTPATSVPFAATATANQLVYS

SEQ ID NO: 6505 - protein, 304 aa, Homo sapiens
MAKIEKNAPTMEKKPELFNIMEVDGVPTLILSKEWWEKVCNFQAKPDDLILATYPKSGTTWMHEILDMILNDGDVEKCKRAQTLDRHAFLELKFPHKEKPDLEFVLEMSSPQLIKTHLPSHLIPPSIWKENCKIVYVARNPKDCLVSYYHFHRMASFMPDPQNLEEFYEKFMSGKVVGGSWFDHVKGWWAAKDMHRILYLFYEDIKKNPKHEIHKVLEFLEKTWSGDVINKIVHHTSFDVMKDNPMANHTAVPAHIFNHSISKFMRKGMPGDWKNHFTVALNENFDKHYEKKMAGSTLNFCLEI

SEQ ID NO: 6506 - protein, 395 aa, Homo sapiens
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLEKLCFELDYEPAHISLDPQTSHPKLLLSEDHQRAQFSYKWQNSPDNPQRFDRATCVLAHTGITGGRHTWVWMARVPGDSGCCQFCSPPSVLGTEVAA

SEQ ID NO: 6507 - protein, 481 aa, Homo sapiens
MASAASVTSLADEVNCPICQGTLREPVTIDCGHNFCRACLTRYCEIPGPDLEESPTCPLCKEPFRPGSFRPNWQLANVVENIERLQLVSTLGLGEEDVCQEHGEKIYFFCEDDEMQLCVVCREAGEHATHTMRFLEDAAAPYREQIHKCLKCLRKEREEIQEIQSRENKRMQVLLTQVSTKRQQVISEFAHLRKFLEEQQSILLAQLESQDGDILRQRDEFDLLVAGEICRFSALIEELEEKNERPARELLTDIRSTLIRCETRKCRKPVAVSPELGQRIRDFPQQALPLQREMKMFLENLPNHLVIPTAHISLDPQTSHPKLLLSEDHQRAQFSYKWQNSPDNPQRFDRATCVLAHTGITGGRHTWVVSIDLAHGGSCTVGVVSEDVQRKGELRLRPEEGVWAVRLAWGFVSALGSFPTRLTLKEQPRQVRVSLDYEVGWVTFTNAVTREPIYTFTASFTRKVIPFFGLWGRGSSFSLSS

SEQ ID NO: 6508 - protein, 867 aa, Homo sapiens; identical to SEQ ID NO: 5803

SEQ ID NO: 6509 - protein, 92 aa, Homo sapiens [sequence omitted]

SEQ ID NO: 6510 - protein, 843 aa, Homo sapiens
MAVEDSTLQVVVRVRPPTPRELDSQRRPVVQVVDERVLVFNPEEPDGGFPGLKWGGTHDGPKKKGKDLTFVFDRVFGEAATQQDVFQHTTHSVLDSFLQGYNCSVFAYGATGAGKTHTMLGREGDPGIMYLTTVELYRRLEARQQEKHFEVLISYQEVYNEQIHDLLEPKGPLAIREDPDKGVVVQGLSFHQPASAEQLLEILTRGNRNRTQHPTDANATSSRSHAIFQIFVKQQDRVPGLTQAVQVAKMSLIDLAGSERASSTHAKGERLREGANINRSLLALINVLNALADAKGRKTHVPYRDSKLTRLLKDSLGGNCRTVMIAAISPSSLTYEDTYNTLKYADRAKEIRLSLKSNVTSLDCHISQYATICQQLQAEVAALRKKLQVYEGGGQPPPQDLPGSPKSGPPPEHLPSSPLPPHPPSQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPGPLYSQVTGTRDRDSLGHGGR

SEQ ID NO: 6511 - protein, 186 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPR

SEQ ID NO: 6512 - protein, 606 aa, Homo sapiens [sequence omitted]

SEQ ID NO: 6513 - protein, 1011 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPVHRHPHFTQLPPTHFSPSMEIMQVRK

SEQ ID NO: 6514 - protein, 1027 aa, Homo sapiens
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNDRGDSSTLTKQELKFIGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPVHRHPHFTQLPPTHFSPSMEIMQVRK

SEQ ID NO: 6515 - protein, 188 aa, Homo sapiens; identical to SEQ ID NO: 5612

SEQ ID NO: 6516 - protein, 126 aa, Homo sapiens
MVSSDRPVSLEDEVSHSMKEMIGGCCVCSDERGWAENPLVYCDGHGCSVAVHQACYGIVQVPTGPWFCRKCESQERAARVAESRSVAQAKVQWCDLSPLQPLLPGFKRFSCLSLPNGMQFLLVSLI

SEQ ID NO: 6517 - protein, 179 aa, Homo sapiens
MVSSDRPVSLEDEVSHSMKEMIGGCCVCSDERGWAENPLVYCDGHGCSVAVHQACYGIVQVPTGPWFCRKCESQERAARVMVCNSCWLASSENVTPGYIEHHCACASPHPRCLVSNVPPVSGALMHCFWACLTTAAFFGPQSFTTCHMSFLVSRDILFYIYGFMPFISVVIWRFKKERW

SEQ ID NO: 6518 - protein, 179 aa, Homo sapiens
MGLIFAKLWSLFCNQEHKVIIVGLDNAGKTTILYQFLMNEVVHTSPTIGSNVEEIVVKNTHFLMWDIGGQESLRSSWNTYYSNTEFIILVVDSIDRERLAITKEELYRMLAHEDLRKAAVLIFANKQDMKGCMTAAEISKYLTLSSIKDHPWHIQSCCALTGEGLCQGLEWMTSRIGVR

SEQ ID NO: 6519 - protein, 1114 aa, Homo sapiens
MSQTQDYECRSHNVDLPESRIPGSNTRLEWVEIIEPRTRERMYANLVTGECVWDPPAGVRIKRTSENQWWELFDPNTSRFYYYNASTQRTVWHRPQGCDIIPLAKLQTLKQNTESPRASAESSPGRGSSVSREGSTSSSLEPEPDTEKAQELPARAGRPAAFGTVKEDSGSSSPPGVFLEKDYEIYRDYSADGQLLHYRTSSLRWNSGAKERMLIKVADREPSFLAAQGNGYAPDGPPGVRSRRPSGSQHSPSLQTFAPEADGTIFFPERRPSPFLKRAELPGSSSPLLAQPRKPSGDSQPSSPRYGYEPPLYEEPPVEYQAPIYDEPPMDVQFEAGGGYQAGSPQRSPGRKPRPFLQPNKQGPPSPCQQLVLTKQKCPERFLSLEYSPAGKEYVRQLVYVEQAGSSPKLRAGPRHKYAPNPGGGSYSLQPSPCLLRDQRLGVKSGDYSTMEGPELRHSQPPTPLPQAQEDAMSWSSQQDTLSSTGYSPGTRKRKSRKPSLCQATSATPTEGPGDLLVEQPLAEEQPPCGTSLAPVKRAEGEAEGARGAAEPFLAQARLAWEAQQAHFHMKQRSSWDSQQDGSGYESDGALPLPMPGPVVRAFSEDEALAQQENRHWRRGTFEKLGFPQILLEKSVSVQTNLASPEPYLHPSQSEDLAACAQFESSRQSRSGVPSSSCVFPTFTLRKPSSETDIENWASKHFNKHTQGLFRRKVSIANMLAWSSESIKKPMIVTSDRHVKKEACELFKLIQMYMGDRRAKADPLHVALEVATKGWSVQGLRDELYIQLCRQTTENFRLESLARGWELMAICLAFFPPTPKFHSYLEGYIYRHMDPVNDTKVTQHIKELLERNTKKKSKLRKKPKPYVEEPDGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 6520 - protein, 273 aa, Homo sapiens; identical to SEQ ID NO: 5514

SEQ ID NO: 6521 - protein, 1210 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRTSPLNEDVFATKIKKMNDNDKDITELQEQIYKLLLQPVHVSVSSGYGSLGSSGSQEQLVSIASSSEASGHRVEETKAEQMTLQQVYASVNKIKNLGQQLYIESMTKSSFKPVTGTRTEPNGGGESANGGGECKTFTSFHQTLKNNSVYTEPCEDLRNDEHSPSYQQINCIDSVIRYLKSYNIPALKRKCISCTNTTSSSSEEDKQNHKADDVQALQAGLQIPAIPKSEMPTNGRSIDTGGGAPQILSTAMLSLGSGISQCGYSSTIVHVPPPETARDATLFCEPWTLNMQPAPLTSEEFKHVGLTAAVLSAHTQKEEQNYVDKFREKILSSPYSSYLQQESRSKAKYSYFQGDSTSKQTRSAGCRKGKHKRKKLPEPPDSSSSNTGSGPRRGAHQNAQPCCPSAASSPHTSSPTFPPAAMVPSQAPYLVPAFPLPAATSPGREYAAPGTAPEGLHGLPLSEGLQPYPAFPFPYLDTFMTVFLPDPPVCPLLSPSFLPCPFLGATASSAISPSMSSAMSPTLDPPPSVTSQRREEEKWEAQSEGHPFITSRSSSPLQLNLLQEEMPRPSESPDQMRRNTCPQTEYQCVTGNNGSESSPATTGALSTGSPPRENPSHPTASALSTGSPPMKNPSHPTASALSTGSPPMKNPSHPTASTLSMGLPPSRTPSHPTATVLSTGSPPSESPSRTGSAASGSSDSSIYLTSSVYSSKISQNGQQSQDVQKKETFPNVAEEPIWRMIRQTPERILMTYQVPERVKEVVLKEDLEKLESMRQQQPQFSHGQKEELAKVYNWIQSQTVTQEIDIQACVTCENEDSADGAATSCGQVLVEDSC

SEQ ID NO: 6522 - protein, 378 aa, Homo sapiens
MPRGEAPGPGRRGAKDEALGEESGERWSPEFHLQRKLADSSHSEQQDRNRVSEELIMVVQEMKKYFPSERRNKPSTLDALNYALRCVHSVQANSEFFQILSQNGAPQADVSMYSLEELATIASEHTSKNTDTFVAVFSFLSGRLVHISEQAALILNRKKDVLASSHFVDLLAPQDMRVFYAHTARAQLPFWNNWTQRAARYECAPVKPFFCRIRGGEDRKQEKCHSPFRIIPYLIHVHHPAQPELESEPCCLTVVEKIHSGYEAPRIPVNKRIFTTTHTPGCVFLEVDEKAVPLLGYLPQDLIGTSILSYLHPEDRSLMVAIHQKVLKYAGHPPFEHSPIRFCTQNGDYIILDSSWSSFVNPWSRKISFIIGRHKVRT

SEQ ID NO: 6523 - protein, 597 aa, Homo sapiens
MERPAPLAVLPFSDPAHALSLLRGLSQLRAERKFLDVTLEAAGGRDFPAHRAVLAAASPYFRAMFAGQLRESRAERVRLHGVPPDMLQLLLDFSYTGRVAVSGDNAEPLLRAADLLQFPAVKEACGAFLQQQLDLANCLDMQDFAEAFSCSGLASAAQRFILRHVGELGAEQLERLPLARLLRYLRDDGLCVPKEEAAYQLALRWVRADPPRRAAHWPQLLEAVRLPFVRRFYLLAHVEAEPLVARCPPCLRLLREARDFQAARYDRHDRGPCPRMRPRPSTGLAEILVLVGGCDQDCDELVTVDCYNPQTGQWRYLAEFPDHLGGGYSIVALGNDIYVTGGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVHVGGSLAVLGGKLYVSGGYDNTFELSDVVEAYDPETRAWSVVGRLPEPTFWHGSVSIFRQFMPQTFSGGRGFELDSGSDDMDPGRPRPPRDPDELH

SEQ ID NO: 6524 - protein, 539 aa, Homo sapiens
MERPAPLAVLPFSDPAHALSLLRGLSQLRAERKFLDVTLEAAGGRDFPAHRAVLAAASPYFRAMFAGQLRESRAERVRLHGVPPDMLQLLLDFSYTGRVAVSGDNAEPLLRAADLLQFPAVKEACGAFLQQQLDLANCLDMQDFAEAFSCSGLASAAQRFILRHVGELGAEQLERLPLARLLRYLRDDGLCVPKEEAAYQLALRWVRADPPRRAAHWPQLLEAVRLPFVRRFYLLAHVEAEPLVARCPPCLRLLREARDFQAARYDRHDRGPCPRMRPRPSTGLAEILVLVGGCDQDCDELVTVDCYNPQTGQWRYLAEFPDHLGGGYSIVALGNDIYVTGGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVNFQAGQHWKHRLVLILQPKCHRDECLGSTAMMGGSHLN

SEQ ID NO: 6525 - protein, 688 aa, Homo sapiens
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 6526 - protein, 174 aa, Homo sapiens
MTHCCSPCCQPTCCRTTCCRTTCWKPTTVTTCSSTPCCQPACCVSSCCQPCCRPTCCQNTCCRTTCCQPTCVTSCCQPSCCSTPCCQPTCCGSSCCGQTSCGSSCGQSSSCAPVYCRRTCYYPTTVCLPGCLNQSCGSNCCQPCCRPACCETTCCRTTCFQPTCVSSCCQPSCC

SEQ ID NO: 6527 - protein, 198 aa, Homo sapiens
MVSSCCGSVCSDQGCSQDLCQETCCRPSCCQTTCCRTTCYRPSCCVSSCCRPQCCQSVCCQPTCCRPPRCCISSCCRPSCCMSSCCKPQCCQSVCCQPTTTCCHPRCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 6528 - protein, 431 aa, Homo sapiens
MTSDCSSTHCSPESCGTASGCAPASSCSVETACLPGTCATSRCQTPSFLSRSRGLTGCLLPCYFTGSCNSPCLVGNCAWCEDGVFTSNEKETMQFLNDRLASYLEKVRSLEETNAELESRIQEQCEQDIPMVCPDYQRYFNTIEDLQQKILCTKAENSRLAVQLDNCKLATDDFKSKYESELSLRQLLEADISSLHGILEELTLCKSDLEAHVESLKEDLLCLKKNHEEEVNLLREQLGDRLSVELDTAPTLDLNRVLDEMRCQCETVLANNRREAEEWLAVQTEELNQQQLSSAEQLQGCQMEILELKRTASALEIELQAQQSLTESLECTVAETEAQYSSQLAQIQCLIDNLENQLAEIRCDLERQNQEYQVLLDVKARLEGEINTYWGLLDSEDSRLSCSPCSTTCTSSNTCEPCSAYVICTVENCCL

SEQ ID NO: 6529 - protein, 348 aa, Homo sapiens
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKPEFFQVCHTKKDYEEYGPSICRHNPVFGVMS

SEQ ID NO: 6530 - protein, 90 aa, Homo sapiens; identical to SEQ ID NO: 4795

SEQ ID NO: 6531 - protein, 82 aa, Homo sapiens
MASSSGAGAAAAAAAANLNAVRETMDVLLEISRILNTGLDMETLSICVRLCEQGINPEALSSVIKELRKATEALKAAENMTS

SEQ ID NO: 6532 - protein, 1243 aa, Homo sapiens
METRAAENTAIFMCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 6533 - protein, 757 aa, Homo sapiens
MALGEEKAEAEASEDTKAQSYGRGSCRERELDIPGPMSGEQPPRLEAEGGLISPVWGAEGIPAPTCWIGTDPGGPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 6534 - protein, 179 aa, Homo sapiens
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKENEKLHKEIEQKDNEIARLKKENKELAEVAEHVQYMAELIERLNGEPLDNFESLDNQEFDSEEE

SEQ ID NO: 6535 - protein, 102 aa, Homo sapiens
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEV

SEQ ID NO: 6536 - protein, 752 aa, Homo sapiens
MAEPASVTVTFDDVALYFSEQEWEILEKWQKQMYKQEMKTNYETLDSLGYAFSKPDLITWMEQGRMLLISEQGCLDKTRRTTSPPTDEQLNMKNTGKLLCFDDEGTPRTKEEDCRLNGPQKQDLCAALRGKERKILLAQTATFQSPSLRETEILNKKVSITAYDPDKKDLRHKPRETPGRLEIPTGPRCYSCYVCRKVFQVRRDLLKHKRSHSKSQLCRYPKYKNSSRGKSELRRTQRLLCQKKRFQCSECEKSYFLKGSLVTHQVVHTGQRPYPCPECDKTFRYRANLKKHLCLHRGERPFCCGECGRAFVQQCELTEHLRLHSGEKPFQCPQCDRCFRLKRGMKVHLTQHSGKRPFHCPECGRSFSRKAALKTHQRTHSEEKPFSCGECGRKFIYKIKLDEHIRVHTGEKPFSCPECNKSFRLKRSLKAHGLQHIGKRPFQCPECSRGFFWRNAMRAHQRLHSEQKPFPCAECGKRFTRPSKLACHTRVHDRQKEFPCGECKKTFSQQSRLTQHLKVHTTEKPFSCAECGRSFRRRAHLTEHTRLHSGEEPFQCPECDKSFSWKASMKFHQRMHRDEKPFACGECDKTYTHQSQLTEHLRLHSGEKPYQCPECEKTFRLKGNLKSHLLQHSGQKPFSCVMCGKSFTQQYRLTEHIRVHSGEKPFQCPECDKSYCIRGSLKVHLYKHSGERPFQCPECGKGFLQKRSLKAHLCLHSGERPFSCDECGRSFTYVGALKTHIAVHAKEKPSSL

SEQ ID NO: 6537 - protein, 644 aa, Homo sapiens
MFLTYMETVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPKNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQLKICKLKSTSKELKMKLGTRNRSCFVKLKKQEEKCSYKRRRK

SEQ ID NO: 6538 - protein, 244 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYASSVRTGGESTFGELKGPAVPSSVTLSVLGTSLGQWFPCHLPAVDDNEGTPFQRCLV

SEQ ID NO: 6539 - protein, 925 aa, Homo sapiens
MPHKIGFVVVSSSGHEDGFSARELMIHAPTVSGWRSPRFCQFPQEIVLQMVERCRIRKLQLLAHQYMISSKIEFYISESLPEYFAPYQAERFRRLGYVSLCDNEKTGCKARELKSVYVDAVGQFLKLIFHQNHVNKYNIYNQVALVAINIIGDPADFSDESNTASREKLIDHYLGHNSEDPALEGTYARKSDYISPLDDLAFDMYQDPEVAQIIRKLDERKREAVQKERYDYAKKLKQAIADLQKVGERLGRYEVEKRCAVEKEDYDLAKEKKQQMEQYRAEVYEQLELHSLLDAELMRRPFDLPLQPLARSGSPCHQKPMPSLPQLEERGTENQFAEPFLQEKPSSYSLTISPQHSAVDPLLPATDPHPKINAESLPYDERPLPAIRKHYGEAVVEPEMSNADISDARRGGMLGEPEPLTEKALREASSAIDVLGETLVAEAYCKTWSYREDALLALSKKLMEMPVGTPKEDLKNTLRASVFLVRRAIKDIVTSVFQASLKLLKMIITQYIPKHKLSKLETAHCVERTIPVLLTRTGDSSARLRVTAANFIQEMALFKEVKSLQIIPSYLVQPLKANSSVHLAMSQMGLLARLLKDLGTGSSGFTIDNVMKFSVSALEHRVYEVRETAVRIILDMYRQHQASILEYLPPDDSNTRRNILYKTIFEGFAKIDGRATDAEMRARRKAATEEAEKQKKEEIKALQGQLAALKEIQAEVQEKESDAVKPKNQDIQGGKAAPAEALGIPDEHYLDNLCIFCGERSESFTEEGLDLHYWKHCLMLTRCDHCKQVVEISSLTEHLLTECDKKDGFGKCYRCSEAVFKEELPRHIKHKDCNPAKPEKLANRCPLCHENFSPGEEAWKAHLMGPAGCTMNLRKTHILQKAPALQPGKSSAVAASGPLGSKAGSKIPTPKGGLSKSSSRTYAKR

SEQ ID NO: 6540 - protein, 714 aa, Homo sapiens
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRAVCTSCSIKMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 6541 - protein, 435 aa, Homo sapiens
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRHFDTDTQDLTGIEWAPNGCVLAVWDTCLEYKILLYSLDGRLLSTYSAYEWSLGIKSVAWSPSSQFLAVGSYDGKVRILNHVTWKMITEFGHPAAINDPKIVVYKEAEKSPQLGLGCLSFPPPRAGAGPLPSSESKYEIASVPVSLQTLKPVTDRANPKIGIGMLAFSPDSYFLATRNDNIPNAVWVWDIQKLRLFAVLEQLSPVRAFQWDPQQPRLAICTGGSRLYLWSPAGCMSVQVPGEGKHIPEATDVAALLCAVWHHTG

SEQ ID NO: 6542 - protein, 272 aa, Homo sapiens
MLQLRDSVDSAGTSPTAVLAAGEEVGAGGGPGGGRPGAGTPLRQTLWPLSIHDPTRRARVKEYFVFRPGSIEQAVEEIRVVVRPVEDGEIQGVWLLTEVDHWNNEKERLVLVTEQSLLICKYDFISLQCQQVVRIALNAVDTISYGEFQFPPKSLNKREGFGIRIQWDKQSRPSFINRWNPWSTNVPYATFTEHPMAGADEKTASLCQLESFKALLIQAVKKAQKESPLPGQANGVLILERPLLIETYVGLMSFINNEAKLGYSMTRGKIGF

SEQ ID NO: 6543 - protein, 289 aa, Homo sapiens
MWPFPSRSLFPPPTQAWLQTVSSDPEAQGWGAWNETKEILGPEGGEGKEEKEEEEDAEEDQDGDAGFLLSLLEQENLAECPLPDQELEAIKMKVCAMEQAEGTPRPPGVQQQAEEEEGTAAGQLLSPETVGCPLSGTPEEKVEADHRSVYVGNVDYGGSAEELEAHFSRCGEVHRVTILCDKFSGHPKGYAYIEFATKGSVQAAVELDQSLFRGRVIKVLPKRTNFPGISSTDRGGLRGHPGSRGAPFPHSGLQGRPRLRPQGQNRTPAALTPLWARPLPWVVVSHVIK

SEQ ID NO: 6544 - protein, 421 aa, Homo sapiens
MFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 6545 - protein, 421 aa, Homo sapiens; identical to SEQ ID NO: 6544

SEQ ID NO: 6546 - protein, 709 aa, Homo sapiens
MAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 6547 - protein, 428 aa, Homo sapiens
MVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSQMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 6548 - protein, 138 aa, Homo sapiens
MGEQADGKDSIARQVAPESHWPELRVLILVVSAEKKLTGSTVGMRASVETSPLLRFRAESVVPAHGGDGPLHPGARLPQLRPADHEGQQPVPRHLPRHLPPSLTSMPSPGASSTWCTASTPTTGTPRWRTPLTRAPMP

SEQ ID NO: 6549 - protein, 198 aa, Homo sapiens
MSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 6550 - protein, 213 aa, Homo sapiens
  MOD_RES (1)..(1): Any amino acid
XSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKEVPRRLRPQGAHPAGPGHLCGGLCQRPASV

SEQ ID NO: 6551 - protein, 850 aa, Homo sapiens
MAEVEAVQLKEEGNRHFQLQDYKAATNSYSQALKLTKDKALLATLYRNRAACGLKTESYVQAASDASRAIDINSSDIKALYRRCQALEHLGKLDQAFKDVQRCATLEPRNQNFQEMLRRLNTSIQEKLRVQFSTDSRVQKMFEILLDENSEADKREKAANNLIVLGREEAGAEKIFQNNGVALLLQLLDTKKPELVLAAVRTLSGMCSGHQARATVILHAVRIDRICSLMAVENEEMSLAVCNLLQAIIDSLSGEDKREHRGKEEALVLDTKKDLKQITSHLLDMLVSKKVSGQGRDQALNLLNKNVPRKDLAIHDNSRTIYVVDNGLRKILKVVGQVPDLPSCLPLTDNTRMLASILINKLYDDLRCDPERDHFRKICEEYITGKFDPQDMDKNLNAIQTVSGILQGPFDLGNQLLGLKGVMEMMVALCGSERETDQLVAVEALIHASTKLSRATFIITNGVSLLKQIYKTTKNEKIKIRTLVTSDKTILYSVATTLVNCTNSYDVKEVIPELVQLAKFSKQHVPEEHPKDKKDFIDMRVKRLLKAGVISALACMVKADSAILTDQTKELLARVFLALCDNPKDRGTIVAQGGGKALIPLALEGTDVGKVKAAHALAKIAAVSNPDIAFPGERVYEVVRPLVRLLDTQRDGLQNYEALLGLTNLSGRSDKLRQKIFKERALPDIENYMFENHDQLRQAATECMCNMVLHKEVQERFLADGNDRLKLVVLLCGEDDDKVQNAAAGALAMLTAAHKKLCLKMTQVTTQWLEILQRLCLHDQLSVQHRGLVIAYNLLAADAELAKKLVESELLEILTVVGKQEPDEKKAEVVQTARECLIKCMDYGFIKPVS

SEQ ID NO: 6552 - protein, 183 aa, Homo sapiens; identical to SEQ ID NO: 5652

SEQ ID NO: 6553 - protein, 121 aa, Homo sapiens
MFNKCSFHSSIYRPAADNSASSLCAIICFLNLVIECDLETNSEINKLIIYLFSQNNRIRFSKLLLKILFYISIFSYPELMCEQYVTFIKPGIHYGQVSKKHIIYSTFLSKNFKFQLLRVCW

SEQ ID NO: 6554 - protein, 323 aa, Homo sapiens [sequence omitted]

SEQ ID NO: 6555 - protein, 1039 aa, Homo sapiens; identical to SEQ ID NO: 5934

SEQ ID NO: 6556 - protein, 129 aa, Homo sapiens
MYRQRFLYSLYRHTHWVRCAKFSPDGRLIVSCSEDKTIKIWDTTNKQCVNNFSDSVGDLSLLFHFQKVESYLHQEVQTHRSYYGGLTLMNCIVKVLPKEISKDYILIHHHIFLISTQEHHIPMRKKLRL

SEQ ID NO: 6557 - protein, 725 aa, Homo sapiens
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDLRVLNLMGNPVIRQIPNYRRTVTVRLKHLTYLDDRPVFPKDRACAEAWARGGYAAEKEERQQWESRERKKITDSIEALAMIKQRAEERKRQRESQERGEMTSSDDGENVPASAEGKEEPPGDRETRQKMELFVKESFEAKDELCPEKPSGEEPPVEAKREDGGPEPEGTLPAETLLLSSPVEVKGEDGDGEPEGTLPAEAPPPPPPVEVKGEDGDQEPEGTLPAETLLLSPPVKVKGEDGDREPEGTLPAEAPPPPPLGAAREEPTPQAVATEGVFVTELDGTRTEDLETIRLETKETFCIDDLPDLEDDDETGKSLEDQNMCFPKIEVISSLSDDSDPELDYTSLPVLENLPTDTLSNIFAVSKDTSKAARVPFTDIFKKEAKRDLEIRKQDTKSPRPLIQELSDEDPSGQLLMPPTCQRDAAPLTSSGDRDSDFLAASSPVPTESAATPPETCVGVAQPSQALPTWDLTAFPAPKAS

SEQ ID NO: 6558 - protein, 318 aa, Homo sapiens
  MOD_RES (1)..(1): Any amino acid
XGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLVLS

SEQ ID NO: 6559 - protein, 852 aa, Homo sapiens
MEALGPGGDRASPASSTSSLDLWHLSMRADSAYSSFSAASGGPEPRTQSPGTDLLPYLDWDYVRVVWGGPGPAPPDAALCTSPRPRPAVAARSGPQPTEVPGTPGPLNRQATPLLYALAAEAEAAAQAAEPPSPPASRAAYRQRLQGAQRRVLRETSFQRKELRMSLPARLRPTVPARPPATHPRSASLSHPGGEGEPARSRAPAPGTAGRGPLANQQRKWCFSEPGKLDRVGRGGGPARECLGEACSSSGLPGPEPLEFQHPALAKFEDHEVGWLPETQPQGSMNLDSGSLKLGDAFRPASRSRSASGEVLGSWGGSGGTIPIVQAVPQGAETPRPLFQTKLSRFLPQKEAAVMYPAELPQSSPADSEQRVSETCIVPAWLPSLPDEVFLEEAPLVRMRSPPDPHASQGPPASVHASDQPYGTGLGQRTGQVTVPTEYPLHECPGTAGADDCWQGVNGSVGISRPTSHTPTGTANDNIPTIDPTGLTTNPPTAAESDLLKPVPADALGLSGNDTPGPSHNTALARGTGQPGSRPTWPSQCLEELVQELARLDPSLCDPLASQPSPEPPLGLLDGLIPLAEVRAAMRPACGEAGEEAASTFEPGSYQFSFTQLLPAPREETRLENPATHPVLDQPCGQGLPAPNNSIQGKKVELAARLQKMLQDLHTEQERLQGEAQAWARRQAALEAAVRQACAPQELERFSRFMADLERVLGLLLLLGSRLARVRRALARAASDSDPDEQASLLQRLRLLQRQEEDAKELKEHVARRERAVREVLVRALPVEELRVYCALLAGKAAVLAQQRNLDERIRLLQDQLDAIRDDLGHHAPSPSPARPPGTCPPVQPPFPLLLT

SEQ ID NO: 6560 - protein, 591 aa, Homo sapiens
MAQGSVSFNDVTVDFTQEEWQHLDHAQKTLYMDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGEKPYVCNECGKSFSYKRNLIVHQRTHKGENIEMQ

SEQ ID NO: 6561 - protein, 977 aa, Homo sapiens
MGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 6562 - protein, 753 aa, Homo sapiens
MDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRVRAQDEEVHQVPGGRQQETAPRRL

SEQ ID NO: 6563 - protein, 386 aa, Homo sapiens
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQQYPQHSLHSMCTQLDVHWTLATFSKMQKKATGFQENVPVPDPF

SEQ ID NO: 6564 - protein, 335 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPVDDINADKNISSAQIVGPGPKPEASAKLPSRPADNYDNFVLPELPSVPDTLPTASAGASTSASEDIDFDDLSRRFEELKKKT

SEQ ID NO: 6565 - protein, 366 aa, Homo sapiens
MLGSGFKAERLRVNLRLVINRLKLLEKKKTELAQKARKEIADYLAAGKDERARIRVEHIIREDYLVEAMEILELYCDLLLARFGLIQSMKELDSGLAESVSTLIWAAPRLQSEVAELKIVADQLCAKYSKEYGKLCRTNQIGTVNDRLMHKLSVEAPPKILVERYLIEIAKNYNVPYEPDSVVMAEAPPGVETDLIDVGFTDDVKKGGPGRGGSGGFTAPVGGPDGTVPMPMPMPMPMPSANTPFSYPLPKGPSDFNGLPMGTYQAFPNIHPPQIPATPPSYESVDDINADKNISSAQIVGPGPKPEASAKLPSRPADNYDNFVLPELPSVPDTLPTASAGASTSASEDIDFDDLSRRFEELKKKT

SEQ ID NO: 6566 - protein, 315 aa, Homo sapiens
MEKYEKLAKTGEGSYGVVFKCRNKTSGQVVAVKKFVESEDDPVVKKIALREIRMLKQLKHPNLVNLIEVFRRKRKMHLVFEYCDHTLLNELERNPNGVADGVIKSVLWQTLQALNFCHIHNCIHRDIKPENILITKQGIIKICDFGFAQILIPGDAYTDYVATRWYRAPELLVGDTQYGSSVDIWAIGCVFAELLTGQPLWPGKSDVDQLYLIIRTLGKLIPRHQSIFKSNGFFHGISIPEPEDMETLEEKFSDVHPVALNFMKGCLKMNPDDRLTCSQLLESSYFDSFQEAQIKRKARNEGRNRRRQQVLPLKS

SEQ ID NO: 6567 - protein, 315 aa, Homo sapiens
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEVTHQGLSPLTLLILVSSHH

SEQ ID NO: 6568 - protein, 357 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCAYVAKPESLS

SEQ ID NO: 6569 - protein, 385 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 6570 - protein, 295 aa, Homo sapiens
MKKEHVLHCQFSAWYPFFRGVTIKSVILPLPQNVKDYLLDDGTLVVSGRDDPPTHSQPDSDDEAEEIQWSDDENTATLTAPEFPEFATKVQEAINSLGGSVFPKLNWSAPRDAYWIAMNSSLKCKTLSDIFLLFKSSDFITRDFTQPFIHCTDDSPDPCIEYELVLRKWCELIPGAEFRCFVKENKLIVVFDIYRDSRGKVWLIDFNPFGEVTDSLLFTWEELISENNLNGDFSEVDAQEQDSPAFRCTNSEVTVQPSPYLSYRLPKDFVDLSTGEDAHKLIDFLKLKRNQQEDD

SEQ ID NO: 6571 - protein, 1090 aa, Homo sapiens
MEQPKGVDWTVIILTCQYKDSVQVFQRELEVRQKREQIPAGTLLLAVEDPEKRVGSGGATLNALLVAAEHLSARAGFTWICVGVSLWIRGCHPPGRLPEASVHRAFPLLQVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 6572 - protein, 105 aa, Homo sapiens
MLELAQDRLQFETVEVSEPSMLQKILTTRRRETGGNEPLPVPTLQHHLAPPAEARKVPSASQVQAIKCFLSKCWSLNISTKEYAYLKGTVLFNPGKGKENDCNHH

SEQ ID NO: 6573 - protein, 470 aa, Homo sapiens
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPDVPGLQCVKYIQGLQWGTQQILSEHTRMTHQGPHDRFIELNSTLFLLRFINANVIAELFFRPIIGTVSMDDMMLEMLCTKI

SEQ ID NO: 6574 - protein, 675 aa, Homo sapiens
MLRATAPCWFPPGYPEAKKVAEEAALEASRHLGGEQSQAGAPEGSKMLRATAPCWFRPGYPEAKKVAKEAAPEASRHLGAEQSPAGAPEGSKMLRATAPCWFPPGYPEAKKVAEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNRSGMACKTTATTSSKRIVRRASLPSLSLKKPIILRSSGCQVPTVLRRGYLQLFTEECLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRVRSSQVAGGRVSQYTCCAAAPGSVGCQVAKQHVRDGRKESLDGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDASACLQLVMWKVRQRAQIQPRHRSASPAALACP

SEQ ID NO: 6575 - protein, 236 aa, Homo sapiens
MHTTQKDTTYTKIFVGGLPYHTTDASLRKYFEVFGEIEEAVVITDRQTGKSRGYGFVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 6576 - protein, 1462 aa, Homo sapiens
MAPVHGDDSLSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 6577 - protein, 890 aa, Homo sapiens; identical to SEQ ID NO: 4762

SEQ ID NO: 6578 - protein, 1468 aa, Homo sapiens
MAPVHGDDCEIGASALSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 6579 - protein, 132 aa, Homo sapiens
MVEPFLGTWKLVSSENFEDYMKELGVNFAARNMAGLVKPTVTISVDGKMMTIRTESSFQDTKISFKLGEEFDETTADNRKVKSTITLENGSMIHVQKWLGKETTIKRKIVDEKMVVECKMNNIVSTRIYEKV

SEQ ID NO: 6580 - protein, 184 aa, Homo sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 6581 - protein, 224 aa, Homo sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 6582 - protein, 94 aa, Homo sapiens
PRAARSRGPAVSRPRAPRPELTTEAGEPARRCVPPYEHRPGMQCAVTTPPPSYYPYPNLRWDTSHFKKSGGPQRNNYVIHPEFVSETYPDYRCW

SEQ ID NO: 6583 - protein, 369 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 6584 - protein, 351 aa, Homo sapiens
MVGHQECIMEEDNRAPQLWRKTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 6585 - protein, 199 aa, Homo sapiens
MADKSKFIEYIDEALEKSKETALSHLFFTYQGIPYPITMCTSETFQALDTFEARHDDIVLASYPKCGSNWILHIVSELIYAVSKKKYKYPEFPVLECGDSEKYQNLAAGIKQIAEFLGFFLTGEQIQTISVQSTFQAMRAKSQDTHGAVGPFLFRKGEVGDWKNLFSEIQNQEMDEKFKECLAGTSLGAKLKYESYCQG

SEQ ID NO: 6586 - protein, 508 aa, Homo sapiens
MRCPKSAVTMRNEELLLSNGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 6587 - protein, 404 aa, Homo sapiens
MGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKVRPLCPPVWE

SEQ ID NO: 6588 - protein, 673 aa, Homo sapiens
MDHSCTRFIHRRGPPTRTRAGFKRGKRPRIQQRPRARVSGTIPASRLHPAPASQPGPCPAPGHCPVGPAHERPMGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKKRMQQIMAHCFLAAKPKLDCKLGYFDLIGCDFLIDDNFKVWLLEMNSNPALHTNCEVLKEVIPGVVIETLDLVLETFRKSLRGQKMLPLLSQRRFVLLHNGEADPRPHLGGSCSLRRWPPLPTRQAKSSGPPMPHAPDQPGARRPAPPPLVPQRPRPPGPDLDSAHDGEPQAPGTEQSGTGNRHPAQEPSPGTAKEEREEPENARP

SEQ ID NO: 6589 - protein, 673 aa, Homo sapiens; identical to SEQ ID NO: 6588

SEQ ID NO: 6590 - protein, 130 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPD

SEQ ID NO: 6591 - protein, 293 aa, Homo sapiens; identical to SEQ ID NO: 5899

SEQ ID NO: 6592 - protein, 266 aa, Homo sapiens
MTEDSQRNFRSVYYEKVGFRGVEEKKSLEILLKDDRLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 6593 - protein, 1223 aa, Homo sapiens
MMSLSVRPQRRLLSARVNRSQSFAGVLGSHERGPSLSFRSFPVFSPPGPPRKPPALSRVSRMFSVAHPAAKVPQPERLDLVYTALKRGLTAYLEVHQQEQEKLQGQIRESKRNSRLGFLYDLDKQVKSIERFLRRLEFHASKIDELYEAYCVQRRLRDGAYNMVRAYTTGSPGSREARDSLAEATRGHREYTESMCLLESELEAQLGEFHLRMKGLAGFARLCVGDQYEICMKYGRQRWKLRGRIEGSGKQVWDSEETIFLPLLTEFLSIKVTELKGLANHVVVGSVSCETKDLFAALPQVVAVDINDLGTIKLSLEVTWSPFDKDDQPSAASSVNKASTVTKRFSTYSQSPPDTPSLREQAFYNMLRRQEELENGTAWSLSSESSDDSSSPQLSGTARHSPAPRPLVQQPEPLPIQVAFRRPETPSSGPLDEEGAVAPVLANGHAPYSRTLSHISEASVDAALAEASVEAVGPESLAWGPSPPTHPAPTHGEHPSPVPPALDPGHSATSSTLGTTGSVPTSTDPAPSAHLDSVHKSTDSGPSELPGPTHTTTGSTYSAITTTHSAPSPLTHTTTGSTHKPIISTLTTTGPTLNIIGPVQTTTSPTHTMPSPTHTTASPTHTSTSPTHTPTSPTHKTSMSPPTTTSPTPSGMGLVQTATSPTHPTTSPTHPTTSPILINVSPSTSLELATLSSPSKHSDPTLPGTDSLPCSPPVSNSYTQADPMAPRTPHPSPAHSSRKPLTSPAPDPSESTVQSLSPTPSPPTPAPQHSDLCLAMAVQTPVPTAAGGSGDRSLEEALGALMAALDDYRGQFPELQGLEQEVTRLESLLMQRQGLTRSRASSLSITVEHALESFSFLNEDEDEDNDVPGDRPPSSPEAGAEDSIDSPSARPLSTGCPALDAALVRHLYHCSRLLLKLGTFGPLRCQEAWALERLLREARVLEAVCEFSRRWEIPASSAQEVVQFSASRPGFLTFWDQCTERLSCFLCPVERVLLTFCNQYGARLSLRQPGLAEAVCVKFLEDALGQKLPRRPQPGPGEQLTVFQFWSFVETLDSPTMEAYVTETAEEVLLVRNLNSDDQAVVLKALRLAPEGRLRRDGLRALSSLLVHGNNKVMAAVSTQLRSLSLGPTFRERALLCFLDQLEDEDVQTRVAGCLALGCIKAPEGIEPLVYLCQTDTEAVREAARQSLQQCGEEGQSAHRRLEESLDALPRIFGPGSMASTAF

SEQ ID NO: 6594 - protein, 40 aa, Homo sapiens
MADEELEALRRQRLAELQAKHGDPGDAAQQEAKHSSTEEK

SEQ ID NO: 6595 - protein, 137 aa, Homo sapiens
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 6596 - protein, 530 aa, Homo sapiens
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNAENWCYYEGLEKALQISTLEERLQIYEEISKQHPKAITPRRLPLTLVPGERFRELMDKFLRVNFSKGCPPLFTTLKSLYYNTEKVSIIQELVTNYEASLKTCDFFSPYENGEKEPPTTLLWVQYFLAQHFDKLGQYSLALDYINAAIASTPTLIELFYMKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERHSPSTWTTGGKEPQMHP

SEQ ID NO: 6597 - protein, 864 aa, Homo sapiens
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNAENWCYYEGLEKALQISTLEERLQIYEEISKQHPKAITPRRLPLTLVPGERFRELMDKFLRVNFSKGCPPLFTTLKSLYYNTEKVSIIQELVTNYEASLKTCDFFSPYENGEKEPPTTLLWVQYFLAQHFDKLGQYSLALDYINAAIASTPTLIELFYMKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERHFFEITDDQFDFHTYCMRKMTLRAYVDLLRLEDILRRHAFYFKAARSAIEIYLKLYDNPLTNESKQQEINSENLSAKELKKMLSKQRRAQKKAKLEEERKHAERERQQKNQKKKRDEEEEEASGLKEELIPEKLERVENPLEEAVKFLIPLKNLVADNIDTHLLAFEIYFRKGKFLLMLQSVKRAFAINSNNPWLHECLIRFSKSVSNHSNLPDIVSKVLSQEMQKIFVKKDLESFNEDFLKRNATSLQHLLSGAKMMYFLDKSRQEKAIAIATRLDETIKDKDVKTLIKVSEALLDGSFGNCSSQYEEYRMACHNLLPFTSAFLPAVNEVDNPNVALNHTANYDVLANEI

SEQ ID NO: 6598 - protein, 555 aa, Homo sapiens; identical to SEQ ID NO: 5259

SEQ ID NO: 6599 - protein, 209 aa, Homo sapiens
MAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQEGPLSNRVEQMRPRNHW

SEQ ID NO: 6600 - protein, 285 aa, Homo sapiens
NWNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 6601 - protein, 383 aa, Homo sapiens; identical to SEQ ID NO: 5734

SEQ ID NO: 6602 - protein, 376 aa, Homo sapiens; identical to SEQ ID NO: 6053

SEQ ID NO: 6603 - protein, 103 aa, Homo sapiens
MIRAFPTTTPRSLHLFTSSTFLARALPGAFPTGACEERLSVPESTPFTAVLKFAAEEFKVPAATSAIITNDGIGINPAQTAGNVFLKHGSELRIIPRDRVGSC

SEQ ID NO: 6604 - protein, 655 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGHKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDRTIRFWDLEKFQVVSCIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 6605 - protein, 54 aa, Homo sapiens
MFLSAVFFAKSKSNETKSPLRGKEKNTLPLNGGLKMTLIYKEKTEGGDTDSEIL

SEQ ID NO: 6606 - protein, 818 aa, Homo sapiens
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGLRKIQSMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTDLVHFDIPSIHIELGSTLRLSPLEHMRRHSVTDKRDSEEESESTAL

SEQ ID NO: 6607 - protein, 337 aa, Homo sapiens
MTNNSGSKAELVVGGKYKLVRKIGSGSFGDVYLGITTTNGEDVAVKLESQKVKHPQLLYESKLYTILQGGVGIPHMHWYGQEKDNNVLVMDLLGPSLEDLFNFCSRRFTMKTVLMLADQMISRIEYVHTKNFLHRDIKPDNFLMGTGRHCNKLFLIDFGLAKKYRDNRTRQHIPYREDKHLIGTVRYASINAHLGIEQSRRDDMESLGYVFMYFNRTSLPWQGLRAMTKKQKYEKISEKKMSTPVEVLCKGFPAEFAMYLNYCRGLRFEEVPDYMYLRQLFRILFRTLNHQYDYTFDWTMLKQKAAQQAASSSGQGQQAQTQTGKQTEKNKNNVKDN

SEQ ID NO: 6608 - protein, 535 aa, Homo sapiens; identical to SEQ ID NO: 4760

SEQ ID NO: 6609 - protein, 722 aa, Homo sapiens
METSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 6610 - protein, 880 aa, Homo sapiens
MTTEQRRSLQAFQDYIRKTLDPTYILSYMAPWFREGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 6611 - protein, 925 aa, Homo sapiens
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 6612 - protein, 328 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGQEKVIFPTLFMGQ

SEQ ID NO: 6613 - protein, 965 aa, Homo sapiens
MALLCGLGQVTLRIWVSLPSQSENGIGFLAARAFLRSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 6614 - protein, 600 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLQLDLQKMELLESKMTEEQHSLKSKIKQMTTDLEIYNDLPALKSSGEEKIKKLHQERMILSTHRNAFKKIMEKQNIEYEALKTQLQENETHSQLTNLERKWQHLEQNNFAMKEFIATKSQESDYQPIKKNVTKQIAEYNKTIVDALHSTSGN

SEQ ID NO: 6615 - protein, 193 aa, Homo sapiens
MLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGPLGPYSAYVSLCGAP

SEQ ID NO: 6616 - protein, 358 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 6617 - protein, 251 aa, Homo sapiens
MAASTMSICSSACTDSWRVVDCPESCCEPCCCAPAPSLTLVCTPVSCVSSPCCQTACEPSACQSGYTSSCTTPCYQQSSCQPDCCTSSPCQQACCVPVCCVPVCCVPVCNKPVCFVPTCSESSPSCCQQSSCQPTCCTSSPCQQACCVPVCSKSVCYVPVCSGASTSCCQQSSCQPACCTASCCRPSSSVSLLCHPVCKSTCCVPVPSCGASASSCQPSCCRTASCVSLLCRPVCSRPACYSLCSGQKSSC

SEQ ID NO: 6618 - protein, 375 aa, Homo sapiens
MAASTMSVCSSDLSYGSRVCLPGSCDSCSDSWQVDDCPESCCEPPCCAPSCCAPAPCLSLVCTPVSRVSSPCCPVTCEPSPCQSGCTSSCTPSCCQQSSCQLACCASSPCQQACCMPVCCKTVCCKPVYCVPVCSGDSSCCQQSSCQSACCTSSPCQQACCVPICCKPVCSGISSSCCQQSSCVSCVSSPCCQAVCEPSPCQSGCISSCTPSCCQQSSCQPACCTSSPCQQACCVPVCCKPVCCVPTCSDDSGSCCQPACCTSSQSQQGCCVPVCCKPVCCVPVCSGASSSCCQQSSCQPACCTTSCCRPSSSVSLLCRPVCRPTCCVPVPSCCAPTSSCQASCCRPASCVSLLCRPACSRPACCGPTSTQKSSC

SEQ ID NO: 6619 - protein, 528 aa, Homo sapiens
MATRVEEAARGRGGGAEEATEAGRGGRRRSPRQKFEIGTMEEAGICGLGVKADMLCNSQSNDILQHQGSNCGGTSNKHSLEEDEGSDFITENRNLVSPAYCTQESREEIPGGEARTDPPDGQQDSECNRNKEKTLGKEVLLLMQALNTLSTPEEKLAALCKKYADLLEESRSVQKQMKILQKKQAQIVKEKVHLQSEHSKAILARSKLESLCRELQRHNKTLKEENMQQAREEEERRKEATAHFQITLNEIQAQLEQHDIHNAKLRQENIELGEKLKKLIEQYALREEHIDKVFKHKELQQQLVDAKLQQTTQLIKEADEKHQREREFLLKEATESRHKYEQMKQQEVQLKQQLSLYMDKFEEFQTTMAKSNELFTTFRQEMEKMTKKIKKLEKETIIWRTKWENNNKALLQMAEEKTVRDKEYKALQIKLERLEKLCRALQTERNELNEKVEVLKEQVSIKAAIKAANRDLATPVMQPCTALDSHKELNTSSKRALGAHLEAEPKSQRSAVQKPPSTGSAPAIESVD

SEQ ID NO: 6620 - protein, 132 aa, Homo sapiens
MRASPCISQPAASWHPRPSALRPTAGSGPDTRTPGTVEDGSAPCPAFRSPAVSPCGEEPCCFQISPAEETLELGRLVSPGNCDTLSPRAAGFYACHVRSLIPCRSTKGRWPLTASAAGLSRHAQCGPSLGLG

SEQ ID NO: 6621 - protein, 647 aa, Homo sapiens
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKSTGIGIEGFSELIQRNMKQLNYSLLCLPEDIRTRGVEDIPGYYYRDDGMQIWGAVERFVSEIIGIYYPSDESVQDDRELQAWVREIFSKGFLNQESSGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 6622 - protein, 676 aa, Homo sapiens
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKLLIPHTRYTLHINTLARELLIVPGQVVDRSTGIGIEGFSELIQRNMKQLNYSLLCLPEDIRTRGVEDIPGYYYRDDGMQIWGAVERFVSEIIGIYYPSDESVQDDRELQAWVREIFSKGFLNQESSGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 6623 - protein, 554 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLLLLDPPAPGLRSPRRRRGGSGLCLPWPWP

SEQ ID NO: 6624 - protein, 925 aa, Homo sapiens
MATSADSPSSPLGAEDLLSDSSEPPGLNQVSSEVTSQLYASLRLSRQAEATARAQLYLPSTSPPHEGLDGFAQELSRSLSVGLEKNLKKKDGSKHIFEMESVRGQLQTMLQTSRDTAYRDPLIPGAGSERREEDSFDSDSTATLLNTRPLQDLSPSSSAQALEELFPRYTSLRPGPPLNPPDFQGLRDALDSEHTRRKHCERHIQSLQTRVLELQQQLAVAVAADRKKDTMIEQLDKTLARVVEGWNRHEAERTEVLRGLQEEHQAAELTRSKQQETVTRLEQSLSEAMEALNREQESARLQQRERETLEEERQALTLRLEAEQQRCCVLQEERDAARAGQLSEHRELETLRAALEEERQTWAQQEHQLKEHYQALQEESQAQLEREKEKSQREAQAAWETQHQLALVQSEVRRLEGELDTARRERDALQLEMSLVQARYESQRIQLESELAVQLEQRVTERLAQAQESSLRQAASLREHHRKQLQDLSGQHQQELASQLAQFKVEMAEREERQQQVAEDYELRLAREQARVCELQSGNQQLEEQRVELVERLQAMLQAHWDEANQLLSTTLPPPNPPAPPAGPSSPGPQEPEKEERRVWTMPPMAVALKPVLQQSREARDELPGAPPVLCSSSSDLSLLLGPSFQSQHSFQPLEPKPDLTSSTAGAFSALGAFHPDHRAERPFPEEDPGPDGEGLLKQGLPPAQLEGLKNFLHQLLETVPQNNENPSVDLLPPKSGPLTVPSWEEAPQVPRIPPPVHKTKVPLAMASSLFRVPEPPSSHSQGSGPSSGSPERGGDGLTFPRQLMEVSQLLRLYQARGWGALPAEDLLLYLKRLEHSGYKPGRKEEGFSGWKLDYGEWSGTDGRGDNVPRRNTDSRLGEIPRKEIPSQAVPRRLATAPKTEKPPARKKSGHPAPSSMRSRGGVWR

SEQ ID NO: 6625 - protein, 986 aa, Homo sapiens
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHTTGQVVSFGHGPSDTSKPTHPEALTENFDISCLISAEDFVDVQVKHIFAGTYANFVTTHQDTSSTRAPGKTLPEISRISQSMAEKWIAVKRRSTEHEMAKSEIRMIFSSPACLTASFLKKRGTGETTSIDVDLEMARDTFKKLTKKEWISSMITTCLEDDLLRALPCHSPHQEALSVFLLLPECPVMHDSKNWKNLVVPFAKAVCEMSKQSLQVLKKCWAFLQESSLNPLIQMLKAAIISQLLHQTKTEQDHCNVKALLGMMKELHKVNKANCRLPENTFNINELSNLLNFYIDRGRQLFRDNHLMSEKKAYMLMHETILQKKDEFPPSPRFILRVRRSRLVKDALRQLSQAEATDFCKVLVVEFINEICPESGGVSSEFFHCMFEEMTKPEYGMFMYPEMGSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 6626 - protein, 144 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTVLVPAPGKLFALRRSPFPPAKCHLARCHGLYL

SEQ ID NO: 6627 - protein, 108 aa, Homo sapiens
MADPRVRQIKIKTGVVKRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 6628 - protein, 446 aa, Homo sapiens
MRECLSIHIGQAGIQIGDACWELYCLEHGIQPNGVVLDTQQDQLENAKMEHTNASFDTFFCETRAGKHVPRALFVDLEPTVIDGIRTGQHRSLFHPEQLLSGKEDAANNYARGRYSVGSEVIDLVLERTRKLAEQCGGLQGFLIFRSFGGGTGSGFTSLLMERLTGEYSRKTKLEFSVYPAPRISTAVVEPYNSVLTTHSTTEHTDCTFMVDNEAVYDICHRKLGVECPSHASINRLVVQVVSSITASLRFEGPLNVDLIEFQTNLVPYPRIHFPMTAFAPIVSADKAYHEQFSVSDITTACFESSNQLVKCDPRLGKYMACCLLYRGDVVPKEVNAAIAATKSRHSVQFVDWCPTGFKVGINNRPPTVMPGGDLAKVHRSICMLSNTTAIVEAWARLDHKFDLMYAKRAFLHWYLREGMEEAEFLEAREDLAALERDYEEVAQSF

SEQ ID NO: 6629 - protein, 290 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHGPFVMNTNEEISQAILDFRNAKNGFERAKTWKSKIGN

SEQ ID NO: 6630 - protein, 290 aa, Homo sapiens; identical to SEQ ID NO: 6629

SEQ ID NO: 6631 - protein, 399 aa, Homo sapiens
MDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMQTIPQATAAKYPRTIHPESSTSASRSLGTRSAHTQSLTSVHSIKVVD

SEQ ID NO: 6632 - protein, 242 aa, Homo sapiens
MAAVKASTSKATRPWYSHPVYARYWQHYHQAMAWMQSHHNAYRKAVESCFNLPWYLPSALLPQSSYDNEAAYPQSFYDHHVAWQDYPCSSSHFRRSGQHPRYSSRIQASTKEDQALSKEEEMETESDAEVECDLSNMEITEELRQYFAETERHREERRRQQQLDAERLDSYVNADHDLYCNTRRSVEAPTERPGERRQAEMKRLYGDSAAKIQAMEAAVQLSFDKHCDRKQPKYWPVIPLKF

SEQ ID NO: 6633 - protein, 493 aa, Homo sapiens
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRVRSLIAEERRNFLPTHQWIVTKTRLQTSSPNLQSRRQGQVQEHGACTAGEGQGLLGHAALLDAMAEETRQKQLLADEKMKQLTEETEVLAHEIERLQMEMKEDDVSFLMKHKSRKRRLFCTMEPEPVQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 6634 - protein, 490 aa, Homo sapiens
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPSTSRDKDYRARGRDDKGRKNMQDGASDGEMPKFDGAGYDKDLVEALERDIVSRNPSIHWDDIADLEEAKKLLREAVVLPMWMPDFFKGIRRPWKGVLMVGPPGTGKTMLAKAVATECGTTFFNVSSSTLTSKYRGESEKLVRLLFEMARFYAPTTIFIDEIDSICSRRGTSDEHEASRRVKSELLIQMDGVGGALENDDPSKMVMVLAATNFPWDIDEALRRRLEKRIYIPLPTAKGRAELLKINLREVELDPDIQLEDIAEKIEGYSGADITNVCRDASLMAMRRRINGLSPEEIRALSKEELQMPVTKGDFELALKKIAKSVSAADLEKYEKWMVEFGSA

SEQ ID NO: 6635 - protein, 490 aa, Homo sapiens; identical to SEQ ID NO: 6634

SEQ ID NO: 6636 - protein, 355 aa, Homo sapiens
MDFIFHEKQEGFLCAQHCLNNLLQGEYFSPVELASIAHQLDEEERMRMAEGGVTSEEYLAFLQQPSENMDDTGFFSIQVISNALKFWGLEIIHFNNPEYQKLGIDPINERSFICNYKQHWFTIRKFGKHWFNLNSLLAGPELISDTCLANFLARLQQQAYSVFVVKGDLPDCEADQLLQIISVEEMDTPKLNGKKLVKQKEHRVYKTVLEKVSEESDESGTSDQDEEDFQRALELSRQETNREDEHLRSTIELSMQGSSGNTSQDLPKTSCVTPASEQPKKIKEDYFEKHQQEQKQQQQQSDLPGHSSYLHERPTTSSRAIESDLSDDISEGTVQAAVDTILEIMRKNLKIKGEK

SEQ ID NO: 6637 - protein, 1969 aa, Homo sapiens
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVGDSADMSATAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 6638 - protein, 381 aa, Homo sapiens
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEERKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKEFCSLEGIECQASEPKLSHHIPSDLHVYIQMA

SEQ ID NO: 6639 - protein, 447 aa, Homo sapiens
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 6640 - protein, 470 aa, Homo sapiens
MDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGLFRFSRIIRKE

SEQ ID NO: 6641 - protein, 171 aa, Homo sapiens
MCGRAPPPEITGREPGYHLVEQSCWLKPLPRNLGHSLFWTVWKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 6642 - protein, 138 aa, Homo sapiens
MGDKKSPTRKPRPVSQLVAQQVTQQFVPPTQSKKEKKDKVEKEKSEKETTSKKNSHKKTRPRLKNVDRSSAQHLEVTVGDLTVIITDFKEKTKSPPASSAASADQHSQSGSSSDNTERGMSRSSSPRGEASSLNGESH

SEQ ID NO: 6643 - protein, 348 aa, Homo sapiens
MGHCCCKPYNCLQCLDKTNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 6644 - protein, 887 aa, Homo sapiens
MNSGGGLPPPSAAASPSSSSLAAAVAVVAPPGVGGVPGGAAVGVKLKYCRYYAKDKTCFYGEECQFLHEDPAAGAAPGLGLHSNSVPLALAGAPVAGFPPGAVAGGGAGPPPGPKKPDLGDPGTGAAAGGGGSSGGLDGPRLAIPGMDGGALTDTSLTDSYFSTSFIGVNGFGSPVETKYPLMQRMTNSSSSPSLLNDSAKPYSAHDPLTSPASSLFNDFGALNISQRRKPRKYRLGMLEERLVPMGSKARKAKNPIGCLADRCKSGVPINMVWWNRVTENNLQTPNPTASEFIPKGGSTSRLSNVSQSNMSAFSQVFSHPSMGSPATAGLAPGMSLSAGSSPLHSPKITPHTSPAPRRRSHTPNPASYMVPSSASTSVNNPVSQTPSSGQVIQKETVGGTTYFYTDTTPAPLTGMVFPNYHIYPPTAPHVAYMQPKANAPSFFMADELRQELINRHLITMAQIDQADMPAVPTEVDSYHSLFPLEPLPPPNRIQKSSNFGYITSCYKAVNSKDDLPYCLRRIHGFRLVNTKCMVLVDMWKKIQHSNIVTLREVFTTKAFAEPSLVFAYDFHAGGETMMSRHFNDPNADAYFTKRKWGQHEGPLPRQHAGLLPESLIWAYIVQLSSALRTIHTAGLACRVMDPTKILITGKTRLRVNCVGVFDVLTFDNSQNNNPLALMAQYQQADLISLGKVVLALACNSLAGIQRENLQKAMELVTINYSSDLKNLILYLLTDQNRMRSVNDIMPMIGARFYTQLDAAQMRNDVIEEDLAKEVQNGRLFRLLAKLGTINERPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 6645 - protein, 569 aa, Homo sapiens
MATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSVFQIICDQYTGKEVVTEKG

SEQ ID NO: 6646 - protein, 686 aa, Homo sapiens
MGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 6647 - protein, 205 aa, Homo sapiens
MSVDPMTYEAQFFGFTPQTCMLRIYIAFQDYLFEVMQAVEQVILKKLDGIPDCDISPVQIRKCTEKFLCFMKGHFDNLFSKMEQLFLQLILRIPSNILLPEDKCKETPYSEEDFQHLQKEIEQLQEKYKTELCTKQALLAELEEQKIVQAKLKQTLTFFDELHNVGRDHGTSDFRESLVSLVQNSRKLQNIRDNVEKESKRLKIS

SEQ ID NO: 6648 - protein, 621 aa, Homo sapiens
MVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 6649 - protein, 846 aa, Homo sapiens; identical to SEQ ID NO: 5306

SEQ ID NO: 6650 - protein, 605 aa, Homo sapiens
MVLCPVIGKLLHKRVVLASASPRRQEILSNAGLRFEVVPSKFKEKLDKASFATPYGYAMETAKQKALEVANRLYQTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 6651 - protein, 231 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGLL

SEQ ID NO: 6652 - protein, 284 aa, Homo sapiens
MWRGLALARAIGCAARGRGQWAVRAADCAQSGRHPGPAVVCGRRLISVLEQIRHFVMMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 6653 - protein, 59 aa, Homo sapiens; identical to SEQ ID NO: 4813

SEQ ID NO: 6654 - protein, 1012 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSINRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGTPKTSVKGVVQNRQKPSQSRVPNRVPVSGVYAGKIQRKRPNVATI

SEQ ID NO: 6655 - protein, 88 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVA

SEQ ID NO: 6656 - protein, 245 aa, Homo sapiens; identical to SEQ ID NO: 4951

SEQ ID NO: 6657 - protein, 516 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 6658 - protein, 833 aa, Homo sapiens
LSRRVPCVRRGCRPPLPPLPGSQSRAWSRDREAPLDPGRPAQSGRRPTSRSVSHACSWNGGSLDPLEGTPALLRSAERLMRKVKKLRLDKENTGSWRSFSLNSEGAERITSYDFHSESGLFLFQASNSLFHCRDGGKNGFMVSPMKPLEIKTQCSGPRMDPKICPADPAFFSFINNSDLWVANIETGEERRLTFCHQGLSNVLDDPKSAGVATFVIQEEFDRFTGYWWCPTASWEGSEGLKTLRILYEEVDESEVEVIHVPSPALEERKTDSYRYPRTGSKNPKIALKLAEFQTDSQGKIVSTQEKELVQPFSSLFPKVEYIARAGWTRDGKYAWAMFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 6659 - protein, 1690 aa, Homo sapiens
MDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALESNYPEDSLLSSSLNVASDSIAGCSSLNQKQKELLESECVEAQFSEAPVDLDASEPQACLNLPGLDLPGTGGDQKSTRVSDVFLPSEGFNFKPHKHPELPTKGKDVSYCPVLAPLPLLLPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKPKKLKETEETPSELSFQDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 6660 - protein, 158 aa, Homo sapiens
MGSGSSRSSRTLRRRRSPESLPAGPGAAALEGGTRRRVPVAAAEVPGAAAEEAPGRDPSPVAPPDGRDETLRLLDELLAESAAWGPPEPAPRRPARLRPTAVAGSAVCAEQSTEGHPGSGNVSEAPGSGRKKPERPAAISYDHSEEGLMASIEREYCR

SEQ ID NO: 6661 - protein, 245 aa, Homo sapiens; identical to SEQ ID NO: 4767

SEQ ID NO: 6662 - protein, 337 aa, Homo sapiens
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHFGMLSRWDDSQRFLSDHPYLVCEETAKYLILWCFHLEAEKKGALMEQIAHQAVVMQFIMEMAKNCNVDPRGCFRLFFQKAKAEEEGYFEAFKNELEAFKSRVRLYSQSQSFQPMTVQNHVPHSGVGSIGLLESLPQNPDYLQYSISTALCSLNSVVHKEDDEPKMMDTV

SEQ ID NO: 6663 - protein, 308 aa, Homo sapiens
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHFGMLSRWDDSQRFLSDHPYLVCEETAKYLILWCFHLEAEKKGALMEQIAHQAVVMQFIMEMAKNCNVDPRGCFRLFFQKAKAEEEGYFEAFKNELEAFKSRVRLYSQSQSFQPMTVQNHVPHSGVGSIGLLESLPQAPRF

SEQ ID NO: 6664 - protein, 1408 aa, Homo sapiens; identical to SEQ ID NO: 5616

SEQ ID NO: 6665 - protein, 175 aa, Homo sapiens
MILNVLEYGSQQVADLTLNLDDYIDAEHLGDFHRTYKNSEELRSRIVSGIITPIHEQWEKANVSSPHREFPPATAREVDPLRIPPHHPHTSRQPPWCDPLGPFVVGGEDLDPFGPRRGGMIVDPLRSGFPRALIDPSSGLPNRLPPGAVPPGARFDPFGPIGTSPPGPRPDRRGQ

SEQ ID NO: 6666 - protein, 183 aa, Homo sapiens
MAGLEVLFASAAPAITCRQDALVCFLHWEVVTHGYFGLGVGDQPGPNDKKSELLPAGWNNNKDLYVLRYEYKDGSRKLLVKAITVESSMILNVLEYGSQQVADLTLNLDDYIDAEHLGDFHRTYKNSEELRSRIVSGIITPIHEQWEKANVSSPHREFPPATAREVDPLRIPPHHPHTSRQPP

SEQ ID NO: 6667 - protein, 295 aa, Homo sapiens; identical to SEQ ID NO: 4796

SEQ ID NO: 6668 - protein, 295 aa, Homo sapiens; identical to SEQ ID NO: 4796

SEQ ID NO: 6669 - protein, 137 aa, Homo sapiens
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 6670 - protein, 576 aa, Homo sapiens
MKCHYEALGVRRDASEEELKKAYRKLALKWHPDKNLDNAAEAAEQFKLIQAAYDVLSDPQERAWYDNHREALLKGGFDGEYQDDSLDLLRYFTVTCYSGYGDDEKGFYTVYRNVFEMIAKEELESVLEEEVDDFPTFGDSQSDYDTVVHPFYAYWQSFCTQKNFAWKEEYDTRQASNRWEKRAMEKENKKIRDKARKEKNELVRQLVAFIRKRDKRVQAHRKLVEEQNAEKARKAEEMRRQQKLKQAKLVEQYREQSWMTMANLEKELQEMEARYEKEFGDGSDENEMEEHELKDEEDGKDSDEAEDAELYDDLYCPACDKSFKTEKAMKNHEKSKKHREMVALLKQQLEEEEENFSRPQIDENPLDDNSEEEMEDAPKQKLSKKQKKKKQKPAQDVPGKDSYLPAAHFQMAWGKKCVLGERRDGESEHKCAKMLLENRQNYDDNFNVNGPGEGVKVDPEDTNLNQDSAKELEDSPQENVSVTEIIKPCDDPKSEAKSVPKPKGKKTKDMKKPVRVPAEPQTMSVLISCTTCHSEFPSRNKLFDHLKATGHARAPSSSSLNSATSSQSKKEKRKNR

SEQ ID NO: 6671 - protein, 265 aa, Homo sapiens
MLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERDRGLTVLPRLVSNSWPQAVLPPWPPKALVLQA

SEQ ID NO: 6672 - protein, 2090 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 6673 - protein, 1377 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 6674 - protein, 1056 aa, Homo sapiens
MATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPTATAAAVAAAAQPQPSVAETYYQTAPKAGYSQGATQYTQAQQTRQVTAIKPATPSPATTTFSIYPVSSTVQPVAAAATVVPSYTQSATYSTTAVTYSGTSYSGYEAAVYSAASSYYQQQQQQQKQAAAAAAAAAATAAWTGTTFTKKAPFQNKQLKPKQPPKPPQIHYCDVCKISCAGPQTYKEHLEGQKHKKKEAALKASQNTSSSNSSTRGTQNQLRCELCDVSCTGADAYAAHIRGAKHQKVVKLHTKLGKPIPSTEPNVVSQATSSTAVSASKPTASPSSIAANNCTVNTSSVATSSMKGLTTTGNSSLNSTSNTKVSAVPTNMAAKKTSTPKINFVGGNKLQSTGNKAEDIKGTECVKSTPVTSAVQIPEVKQDTVSEPVTPASLAALQSDVQPVGHDYVEEVRNDEGKVIRFHCKLCECSFNDPNAKEMHLKGRRHRLQYKKKVNPDLQVEVKPSIRARKIQEEKMRKQMQKEEYWRRREEEERWRMEMRRYEEDMYWRRMEEEQHHWDDRRRMPDGGYPHGPPGPLGLLGVRPGMPPQPQGPAPLRRPDSSDDRYVMTKHATIYPTEEELQAVQKIVSITERALKLVSDSLSEHEKNKNKEGDDKKEGGKDRALKGVLRVGVLAKGLLLRGDRNVNLVLLCSEKPSKTLLSRIAENLPKQLAVISPEKYDIKCAVSEAAIILNSCVEPKMQVTITLTSPIIREENMREGDVTSGMVKDPPDVLDRQKCLDALAALRHAKWFQQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGMDLKLRGKKTKKIMITFKKCL

SEQ ID NO: 6675 - protein, 129 aa, Homo sapiens
MGCCGCSGGCGSGCGGCGSGCGGCGSSCCVPICCCKPVCCCVPACSCTSCGSCGGSKGCCGSCGGSKGGCGSCGGSKGGCGSCGCSQCSCCKPCYCSSGCGSSCCQSSCCKPCCSQASCCVPICCQCKI

SEQ ID NO: 6676 - protein, 447 aa, Homo sapiens
MPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPCVLKRTEGALECSQMEGL

SEQ ID NO: 6677 - protein, 334 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQ

SEQ ID NO: 6678 - protein, 390 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 6679 - protein, 390 aa, Homo sapiens; identical to SEQ ID NO: 6678

SEQ ID NO: 6680 - protein, 366 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 6681 - protein, 382 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQ

SEQ ID NO: 6682 - protein, 613 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVCEICKILVLKNAAAFLCHSKVNRSI

SEQ ID NO: 6683 - protein, 127 aa, Homo sapiens; identical to SEQ ID NO: 5428

SEQ ID NO: 6684 - protein, 178 aa, Homo sapiens
MMRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 6685 - protein, 218 aa, Homo sapiens
MFQVPDSEGGRAGSRKWQLLTGSLASTSPSLLSGQGPWAPLQRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 6686 - protein, 1621 aa, Homo sapiens
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 6687 - protein, 795 aa, Homo sapiens
MKFTNTKVQMMQNVHLAPETDEDDLYSGYNDYNPIYDIEELENDAAFQQAVRTSHGRRPPITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECSGSVRTGHMERDPLNLLPRKSVLPGPEIAKCNYFSGEKYYLSAFLSSSLHRSWIKRCSRICQKTEEVGKNERNKGTAHKVRQRWQWGLPWQKRRKC

SEQ ID NO: 6688 - protein, 63 aa, Homo sapiens
MSYYRSYYGGLGYGYGGFGGWGYGYGCGYGSFRRLGYGCGYGGYGFSCCRPLYYGGYGFSAFY

SEQ ID NO: 6689 - protein, 44 aa, Homo sapiens
MSYYGNYYGGLGYGYDCKYSYTSGFGAFRILDCGYRCGCGGVWI

SEQ ID NO: 6690 - protein, 44 aa, Homo sapiens
MSYYSHLSGGLGCGLAVAVTMGRTVAVAEYGRCRHGCHSSYSAR

SEQ ID NO: 6691 - protein, 45 aa, Homo sapiens
MCYYHNYYGSLDYGCSYGSEYGNSGYACNFPCSYGRFLLAPRKKF

SEQ ID NO: 6692 - protein, 207 aa, Homo sapiens
MPHSHCHSLRSFHNAPPLSAITHGTNPITFEDRLCLPSSFHSRTCFLDNFQETCNETTSCQMTNCEQDLFTDDSCVQSNCFPGVVQTTYSNSRPCERTACQSESSSAGLACVSQPCQSESTQQMGFVAQSCQPASLKGNSCPPKTSKSKNFETLERASSQCQCQSQNPESSSCRPLVNVAPEPQLLESSPGVEPTCCVTGGSQLPSK

SEQ ID NO: 6693 - protein, 214 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLHVFVFHHSLFGATFGEHHFQPCPLPSGNKAPISTWSGDSWLL

SEQ ID NO: 6694 - protein, 214 aa, Homo sapiens; identical to SEQ ID NO: 6693

SEQ ID NO: 6695 - protein, 478 aa, Homo sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 6696 - protein, 257 aa, Homo sapiens
MEEEASSPGLGCSKPHLEKLTLGITRILESSPGVTEVTIIEKPPAERHMISSWEQKNNCVMPEDVKNFYLMTNGFHMTWSVKLDASDDQPEKPHFDSRSVIFELDSCNGSGKVCLVYKSGKPALAEDTEIWFLDRALYWHFLTDTFTAYYRLLITHLGLPQWQYAFTSYGISPQAKQWFSMYKPITYNTNLLTEETDSFVNKLDPSKVFKSKNKIVIPKKKGPVQPAGGQKGPSGPSGPSTSSTSKSSSGSGNPTRK

SEQ ID NO: 6697 - protein, 263 aa, Homo sapiens; identical to SEQ ID NO: 5395

SEQ ID NO: 6698 - protein, 129 aa, Homo sapiens; identical to SEQ ID NO: 6440

SEQ ID NO: 6699 - protein, 541 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 6700 - protein, 160 aa, Homo sapiens; identical to SEQ ID NO: 6461

SEQ ID NO: 6701 - protein, 160 aa, Homo sapiens; identical to SEQ ID NO: 6461

SEQ ID NO: 6702 - protein, 1063 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSERGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGTAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 6703 - protein, 539 aa, Homo sapiens; identical to SEQ ID NO: 5502

SEQ ID NO: 6704 - protein, 225 aa, Homo sapiens
MAAGSEATTPVIVAAGAGGEEGEHVKPFKPEKAKEIIMSLQQPAIFCNMVFDWPARHWNAKYLSQVLHGKQIRFRMGMKSMSTVPQFETTCNYVEATLEEFLTWNCDQSSISGPFRDYDHSKFWAYADYKYFVSLFEDKTDLFQDVKWSDFGFPGRNGQESTLWIGSLGAHTPCHLDSYGCNLVFQVQGRLECNGMIIAPGPQAILLPQPLKYLGLQETMASLSS

SEQ ID NO: 6705 - protein, 856 aa, Homo sapiens; identical to SEQ ID NO: 5076

SEQ ID NO: 6706 - protein, 868 aa, Homo sapiens
MASFPETDFQICLLCKEMCGSPAPLSSNSSASSSSSQTSTSSGGGGGGPGAAARRLHVLPCLHAFCRPCLEAHRLPAAGGGAAGEPLKLRCPVCDQKVVLAEAAGMDALPSSAFLLSNLLDAVVATADEPPPKNGRAGAPAGAGGHSNHRHHAHHAHPRASASAPPLPQAPQPPAPSRSAPGGPAASPSALLLRRPHGCSSCDEGNAASSRCLDCQEHLCDNCVRAHQRVRLTKDHYIERGPPGPGAAAAAQQLGLGPPFPGPPFSILSVFPERLGFCQHHDDEVLHLYCDTCSVPICRECTMGRHGGHSFIYLQEALQDSRALTIQLLADAQQGRQAIQLSIEQAQTVAEQVEMKAKVVQSEVKAVTARHKKALEERECELLWKVEKIRQVKAKSLYLQVEKLRQNLNKLESTISAVQQVLEEGRALDILLARDRMLAQVQELKTVRSLLQPQEDDRVMFTPPDQALYLAIKSFGFVSSGAFAPLTKATGDGLKRALQGKVASFTVIGYDHDGEPRLSGGDLMSAVVLGPDGNLFGAEVSDQQNGTYVVSYRPQLEGEHLVSVTLCNQHIENSPFKVVVKSGRSYVGIGLPGLSFGSEGDSDGKLCRPWGVSVDKEGYIIVADRSNNRIQVFKPCGAFHHKFGTLGSRPGQFDRPAGVACDASRRIVVADKDNHRIQIFTFEGQFLLKFGEKGTKNGQFNYPWDVAVNSEGKILVSDTRNHRIQLFGPDGVFLNKYGFEGALWKHFDSPRGVAFNHEGHLVVTDFNNHRLLVIHPDCQSARFLGSEGTGNGQFLRPQGVAVDQEGRIIVADSRNHRVQMFESNGSFLCKFGAQGSGFGQMDRPSGIAITPDGMIVVVDFGNNRILVF

SEQ ID NO: 6707 - protein, 368 aa, Homo sapiens
MREPVLTWCVPLELLCSHPLPLSAFLKSQVKLYTYRACAGKDEMGKMVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 6708 - protein, 352 aa, Homo sapiens
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 6709 - protein, 192 aa, Homo sapiens
MGKGCKVVVCGLLSVGKTAILEQLLYGNHTIGMEDCETMEDVYMASVETDRGVKEQLHLYDTRGLQEGVELPKHYFSFADGFVLVYSVNNLESFQRVELLKKEIDKFKDKKEVAIVVLGNKIDLSEQRQVDAEVAQQWAKSEKVRLWEVTVTDRKTLIEPFTLLASKLSQPQSKSSFPLPGRKNKGNSNSEN

SEQ ID NO: 6710 - protein, 472 aa, Homo sapiens
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQQHTLETLLEEIKALRERVQAQEQRITALENMLCELVDGTD

SEQ ID NO: 6711 - protein, 875 aa, Homo sapiens
MGDSDDEYDRRRRDKFRRERSDYDRSRERDERRRGDDWNDREWDRGRERRSRGEYRDYDRNRRERFSPPRHELSPPQKRMRRDWDEHSSDPYHSGYEMPYAGGGGGPTYGPPQPWGHPDVHIMQHHVLPIQARLGSIAEIDLGVPPPVMKTFKEFLLSLDDSVDETEAVKRYNDYKLDFRRQQMQDFFLAHKDEEWFRSKYHPDEVGKRRQEARGALQNRLRVFLSLMETGWFDNLLLDIDKADAIVKMLDAAVIKMEGGTENDLRILEQEEEEEQAGKPGEPSKKEEGRAGAGLGDGERKTNDKDEKKEDGKQAENDSSNDDKTKKSEGDGDKEEKKEDSEKEAKKSSKKRNRKHSGDDSFDEGSVSESESESESGQAEEEKEEAEALKEKEKPKEEEWEKPKDAAGLECKPRPLHKTCSLFMRNIAPNISRAEIISLCKRYPGFMRVALSEPQPERRFFRRGWVTFDRSVNIKEICWNLQNIRLRECELSPGVNRDLTRRVRNINGITQHKQIVRNDIKLAAKLIHTLDDRTQLWASEPGTPPLPTSLPSQNPILKNITDYLIEEVSAEEEELLGSSGGAPPEEPPKEGNPAEINVERDEKLIKVLDKLLLYLRIVHSLDYYNTCEYPNEDEMPNRCGIIHVRGPMPPNRISHGEVLEWQKTFEEKLTPLLSVRESLSEEEAQKMGRKDPEQEVEKFVTSNTQELGKDKWLCPLSGKKFKGPEFVRKHIFNKHAEKIEEVKKEVAFFNNFLTDAKRPALPEIKPAQPPGPAQILPPGLTPGLPYPHQTPQGLMPYGQPRPPILGYGAGAVRPAVPTGGPPYPHAPYGAGRGNYDAFRGQGGYPGKPRNRMVRGDPRAIVEYRDLDAPDDVDFF

SEQ ID NO: 6712 - protein, 271 aa, Homo sapiens
MAAVEKRRQAVPPPAGFTDSGRQSVSRAAGAAESEEDFLRQVGVTEMLRAALLKVLEARPEEPIAFLAHYFENMGLRSPVNGGAGEPPGQLLLQQQRLGRALWHLRLAHHSQRAAFNNNVSVAYECLSAGGRRKRPGLDGRTYSELLRRICRDGQAPEEVVAPLLRKVQCRDHEAVPLSVFRAGTLTCFVLLEFVARAGALFQLLEDSAAAVADRRVGQAVLDTLEGALQASDAAAPARFLEAGSRLAPMTREEFLERAAALFIAKVKPVG

SEQ ID NO: 6713 - protein, 658 aa, Homo sapiens
MGGHLSPWPTYTSGQTILQNRKPCSDDYRKRVGSCQQHPFRTAKPQYLEELENYLRKELLLLDLGTDSTQELRLQPYREIFEFFIEDFKTYKPLLSSIKNAYEGMLAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 6714 - protein, 428 aa, Homo sapiens
MEPLKVEKFATAKRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 6715 - protein, 373 aa, Homo sapiens
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQRFHHPKLSSLHRENFIWNLKNVPLLEKYLYALGQNRNREIVEHVIHLFKEEVMTKLSHFRECINHGDLNDHNILIESSKSASGNAEYQVSGILDFGDMSYGYYVFEVAITIMYMMIESKSPIQVGGHVLAGFESITPLTAVEKGALFLLVCSRFCQSLVMAAYSCQLYPENKDYLMVTAKTGWKHLQQMFDMGQKAVEEIWFETAKSYESGISM

SEQ ID NO: 6716 - protein, 921 aa, Homo sapiens
MALLCGLGQVTLRIWVSLPSQSENGIGSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 6717 - protein, 464 aa, Homo sapiens
MAMTAGTTTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKSDMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWKETLVFPPEVPISEKAKDLILRFCIDSENRIGNSGVEEIKGHPFFEGVDWEHIRERPAAIPIEIKSIDDTSNFDDFPESDILQPVPNTTEPDYKSKDWVFLNYTYKRFEGLTQRGSIPTYMKAGKL

SEQ ID NO: 6718 - protein, 1316 aa, Homo sapiens
MASKGAGMSFSRKSYRLTSDAEKSRVTGIVQEKLLNDYLNRIFSSSEHAPPAATSRKPLNFQNLPEHLDQLLQVDNEEEESQGQVEGRLGPSTVVLDHTGGFEGLLLVDDDLLGVIGHSNFGTIRSTTCVYKGKWLYEVLISSQGLMQIGWCTISCRFNQEEGVGDTHNSYAYDGNRVRKWNVTTTNYGKAWAAGDIVSCLIDLDDGTLSFCLNGVSLGTAFENLSRGLGMAYFPAISLSFKESVAFNFGSRPLRYPVAGYRPLQDPPSADLVRAQRLLGCFRAVLSVELDPVEGRLLDKESSKWRLRGQPTVLLTLAHIFHHFAPLLRKVYLVEAVLMSFLLGIVEKGTPTQAQSVVHQVLDLLWLFMEDYEVQDCLKQLMMSLLRLYRFSPIVPDLGLQIHYLRLTIAILRHEKSRKFLLSNVLFDVLRSVVFFYIKSPLRVEEAGLQELIPTTWWPHCSSREGKESTEMKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTTSNLLACLYPHWWEPSHGPNCA

SEQ ID NO: 6719 - protein, 680 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPESTKCNDMRQTGYCPRGPFCAFAHVEKSLGMVNEWGCHDLHLTSPSSTGSGQPGNAKRRDSPAEGGPRGSEQDSKQNHLAVFAAVHPPAPSVSSSVASSLASSAGSGSSSPTALPAPPARALPLGPASSTVEAVLGSALDLHLSNVNIASLEKDLEEQDGHDLGAAGPRSLAGSAPVAIPGSLPRAPSLHSPSSASTSPLGSLSQPLPGPVGSSAMTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 6720 - protein, 153 aa, Homo sapiens
MSSPLASLSKTRKVPLPSEPMNPGRRGIRIYGDVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKP

SEQ ID NO: 6721 - protein, 793 aa, Homo sapiens
MGQCYNLEDDDLETDVNKLSSKPGLDRPEEELMQYEVMCLELSYSFEELQSKLGDDLNSEKTQYANHHHIPAAASSKQHCYSKDQSSCGQEREYAVQTSLLCRVKTGRSTVHLGSKKNPGVNLYQNVQSNSLRRDSSESEIPDIQASPKADAWDVDAIFCPRMSASFSNSTRTREVVKVIDKLLQTHLKRVPFHDPYLYMAKARRTSSVVDFKMMAFPDVWGHCPPPTTQPMLERKCGVQRIRIFEDIRRLIQPSDVINKVVFSLDEPWPLQDNASNCLRFFSKFESGNLRKAIQVREFEYDLLVNADVNSTQHQQWFYFKVSGMQAAIPYHFNIINCEKPNSQFNYGMQPTLYSVKEALLGKPTWIRTGHEICYYKNHYRQSTAVAGGASGKCYYTLTFAVTFPHSEDVCYLAYHYPYTYTALMTHLDILEKSVNLKEVYFRQDVLCQTLGGNPCPLVTITAMPESNSDEHLEQFRHRPYQVITARVHPGESNASWVMKGTLEFLVSSDPVARLLRENFIFKIIPMLNPDGVINGNHRCSLSGEDLNRQWLSPSAHLQPTIYHAKGLLYHLSSIGRSPVVFCDFHGHSQKKNVFLYGCSIKETLWQAACTVGTSTILEEVNYRTLPKILDKLAPAFTMSSCSFLVEKSRASTARVVVWREMGVSRSYTMESSYCGCNQGPYQCTQRLLERTKNERAHPVDGLQGLQFGTRELEEMGAMFCLGLLILELKSASCSHQLLAQAATLLSAEEDALDQHLQRLKSSNFLPKHIWFAYHFFAITNFFKMNLLLHVSP

SEQ ID NO: 6722 - protein, 50 aa, Homo sapiens
MMQNVHLAPETDEDDLYSGYNDYNPIYDIEELENDAAFQQAVRTSHGRRP

SEQ ID NO: 6723 - protein, 432 aa, Homo sapiens
MTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQADREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDSRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIAN

SEQ ID NO: 6724 - protein, 128 aa, Homo sapiens
MAAAAAEQQQFYLLLGNLLSPDNVVRKQAEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIF

SEQ ID NO: 6725 - protein, 921 aa, Homo sapiens
MRPEGAGMELGGGEERLPEESRREHWQLLGNLKTTVEGLVSTNSPNVWSKYGGLERLCRDMQSILYHGLIRDQACRRQTDYWQFVKDIRWLSPHSALHVEKFISVHENDQSSADGASERAVAELWLQHSLQYHCLSAQLRPLLGDRQYIRKFYTDAAFLLSDAHVTAMLQCLEAVEQNNPRLLAQIDASMFARKHESPLLVTKSQSLTALPSSTYTPPNSYAQHSYFGSFSSLHQSVPNNGSERRSTSFPLSGPPRKPQESRGHVSPAEDQTIQAPPVSVSALARDSPLTPNEMSSSTLTSPIEASWVSSQNDSPGDASEGPEYLAIGNLDPRGRTASCQSHSSNAESSSSNLFSSSSSQKPDSAASSLGDQEGGGESQLSSVLRRSSFSEGQTLTVTSGAKKSHIRSHSDTSIASRGAPESCNDKAKLRGPLPYSGQSSEVSTPSSLYMEYEGGRYLCSGEGMFRRPSEGQSLISYLSEQDFGSCADLEKENAHFSISESLIAAIELMKCNMMSQCLEEEEVEEEDSDREIQELKQKIRLRRQQIRTKNLLPMYQEAEHGSFRVTSSSSQFSSRDSAQLSDSGSADEVDEFEIQDGSEGSNLTHISKNGLSVSLASMFSDADIRRNTASSSKSFVSSQSFSHCFLHSTSAEAVAMGLLKQFEGMQLPAASELEWLVPEHDAPQKLLPIPDSLPISPDDGQHADIYKLRIRVRGNLEWAPPRPQIIFNVHPAPTRKIAVAKQNYRCAGCGIRTDPDYIKRLRYCEYLGKYFCQCCHENAQMAIPSRVLRKWDFSKYYVSNFSKDLLIKIWNDPLFNVQDINSALYRKVKLLNQVRLLRVQLCHMKNMFKTCRLAKELLDSFDTVPGHLTEDLHLYSLNDLTATRKGELGPRLAELTRAGATHVERCMVRKSHCSMQLSPCF

SEQ ID NO: 6726 - protein, 547 aa, Homo sapiens
MRALTVQRVKFAMDLPLLKRAGQDLAEKTKNFVSRSLVIGEVLSMADMATGVKCGIIYWLFGGAIRNLGSPEHVTKWFQPLQEQKYTGMFAMTERGHGSNARGIQTEATFDLSAQEFVIDTPCENAEKMYIGNAMYGNYAAVFAQLIIDGRSQGPHCFIVPVRDENGSLYPGVTAIDMMYKEGLHGVDNGILIFDKVRIPRENLLDKFGSVAPDGQYHSPIRNKSARFNAMLAALTPSRLAVAFQAMGAMKLGLTIAIRYSHSRRQFGPKTKEEVKIIEHQTQTLRLMPHLATALALTFVSRYAGALLDEDVFQGKELVNSRSLQALVAGLKAYSTWENIRCLQDCRECTGGMGYMMENRISGLKCDTDVFATFEGDDVVMLQVVGRELLAQYTKQYEEKPLFGLLQNWAESVGDKLRTSFLAFNMDTVDDLAFLLKAVKFRERVLQRGLVARIYYKVKTKKEDFFHAWNSCLHHVASLSLAHTHRVTLEQFSLAVKSCPDQEDQTLLMKFCLLYGTKLVFQERAWYLEHKYLTPMASTRIRNQERC

SEQ ID NO: 6727 - protein, 2028 aa, Homo sapiens
MDVTVSELLELFLQSPLVTWVKTFGPFGSGSQDNLTMYMDLVDGIFLNQIMLQIDPRPTNQRINKHVNNDVNLRIQNLTILVRNIKTYYQEVLQQLIVMNLPNVLMIGRDPLSGKSMEEIKKVLLLVLGCAVQCERKEEFIERIKQLDIETQAGIVAHIQEVTHNQENVFDLQWLELPDVAPEELEALSRSMVLHLRRLIDQRDECTELIVDLTQERDYLQAQHPPSPIKSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKGPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 6728 - protein, 1276 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMENSVVGSSREGCSSLPEIVCEDAAPEVHCDA

SEQ ID NO: 6729 - protein, 998 aa, Homo sapiens
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIYNEMIRDLLNPSLGYLELREDSKGVIQVAGITEVSTINAKEIMQLLMKGNRQRTQEPTAANQTSSRSHAVLQVTVRQRSRVKNILQEVRQGRLFMIDLAGSERASQTQNRGQRMKEGAHINRSLLALGNCINALSDKGSNKYINYRDSKLTRLLKDSLGGNSRTVMIAHISPASSAFEESRNTLTYAGRAKNIKTRVKQNLLNVSYHIAQYTSIIADLRGEIQRLKRKIDEQTGRGQARGRQDRGDIRHIQAEVQLHSGQGEKAGMGQLREQLASAFQEQMDVRRRLLELENRAMEVQIDTSRHLLTIAGWKHEKSRRALKWREEQRKECYAKDDSEKDSDTGDDQPDILEPPEVAAARESIAALVDEQKQLRKQKLALEQRCRELRARGRRLEETLPRRIGSEEQREVLSLLCRVHELEVENTEMQSHALLRDGALRHRHEAVRRLEQHRSLCDEIIQGQRQIIDDYNLAVPQRLEELYEVYLRELEEGSLEQATIMDQVASRALQDSSLPKITPAGTSLTPDSDLESVKTLSSDAQHLQNSALPPLSTESEGHHVFKAGTGAWQAKSSSVPTPPPIQLGSLVTQEAPAQDSLGSWINSSPDSSENLSEIPLSHKERKEILTGTKCIWVKAARRRSRALGTEGRHLLAPATERSSLSLHSLSEGDDARPPGPLACKRPPSPTLQHAASEDNLSSSTGEAPSRAVGHHGDGPRPWLRGQKKSLGKKREESLEAKRRKRRSRSFEVTGQGLSHPKTHLLGPHQAERISDHRMPVCRHPAPGIRHLGKVTLPLAKVKLPPSQNTGPGDSSPLAVPPNPGGGSRRATRGPRLPHGTSTHGKDGCSRHN

SEQ ID NO: 6730 - protein, 397 aa, Homo sapiens
MTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 6731 - protein, 1200 aa, Homo sapiens
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 6732 - protein, 928 aa, Homo sapiens
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGPYLFGAGCFSIKAPCKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 6733 - protein, 166 aa, Homo sapiens
MVNSCCGSVCSDQGCGLENCCRPSYCQTTCCRTTCCRPSCCVSSCCRPQCCQTTCCRTTCCHPSCCVSSCCRPQCCQSVCCQPTCCRPQCCQTTCCRTTCCRPSCCRPQCCQSVCCQPTCCCPSYCVSSCCRPQCCQTTCCRTTCCRPSCCVSRCYRPHCGQSLCC

SEQ ID NO: 6734 - protein, 367 aa, Homo sapiens
MDDAAVLKRRGYLLGINLGEGSYAKVKSAYSERLKFNVAIKIIDRKKAPADFLEKFLPREIEILAMLNHCSIIKTYEIFETSHGKVYIVMELAVQGDLLELIKTRGALHEDEARKKFHQLSLAIKYCHDLDVVHRDLKCDNLLLDKDFNIKLSDFSFSKRCLRDDSGRMALSKTFCGSPAYAAPEVLQGIPYQPKVYDIWSLGVILYIMVCGSMPYDDSNIKKMLRIQKEHRVNFPRSKHLTGECKDLIYHMLQPDVNRRLHIDEILSHCWMQPKARGSPSVAINKEGESSRGTEPLWTPEPGSDKKSATKLEPEGEAQPQAQPETKPEGTAMQMSRQSEILGFPSKPSTMETEEGPPQQPPETRAQ

SEQ ID NO: 6735 - protein, 90 aa, Homo sapiens
MSHYGSYYGGLGYSCGGFGGLGYGYGCGCGSFCRRGSGCGYGGYGYGSGFGSYGYGSGFGGYGYGSGFGGYGYGCCRPSYNGGYGFSGFY

SEQ ID NO: 6736 - protein, 172 aa, Homo sapiens
MSYNCCSRNFSSCSHGGYLHYPGSSCGSSYPSNLVYSTDLCSPSTCQLGSSLYRGCQETCWRPNSCQTLCVESSPCHTSCYYPRTHMLCNSCLTMHVGSRGFGSNSCCSLSCGSRSCSSLGCGSNGFRYLNYRIHTSPSQSYRSRFCHPIYFPPRRWFHSSCYQPFCRSGFY

SEQ ID NO: 6737 - protein, 517 aa, Homo sapiens
MSGSCSSRKCFSVPATSLCSTEVSCGGPICLPSSCQSQTWQLVTCQDSCGSSSCGPQCRQPSCPVSSCAQPLCCDPVICEPSCSVSSGCQPVCCEATTCEPSCSVSNCYQPVCFEATICEPSCSVSNCCQPVCFEATVCEPSCSVSSCAQPVCCEPAICEPSCSVSSCCQPVGSEATSCQPVLCVPTSCQPVLCKSSCCQPVVCEPSCCSAVCTLPSSCQPVVCEPSCCQPVCPTPTCSVTSSCQAVCCDPSPCEPSCSESSICQPATCVALVCEPVCLRPVCCVQSSCEPPSVPSTCQEPSCCVSSICQPICSEPSPCSPAVCVSSPCQPTCYVVKRCPSVCPEPVSCPSTSCRPLSCSPGSSASAICRPTCPRTFYIPSSSKRPCSATISYRPVSRPICRPICSGLLTYRQPYMTSISYRPACYRPCYSILRRPACVTSYSCRPVYFRPSCTESDSCKRDCKKSTSSQLDCVDTTPCKVDVSEEAPCQPTEAKPISPTTREAAAAQPAASKPANC

SEQ ID NO: 6738 - protein, 341 aa, Homo sapiens
MADGCCPGNTTAIPAVPTITTYPVKGGFRHALCLPSSCHSRMWQLVTCQESCQPSIGAPSGCDPASCQPTRLPATSCVGFVCQPMCSHAACYQSGTGQSPCLVSSCQPSCSESTCCQEKCCDASPCQQSSCQESVCMSGSCQAACGQSVCCDAGSCQPSCSEVTSCPETSCLPTICTASPCQPTWCQGSSCQPVSGEGQPCKSTYYQPICYIFKPCQSALYMPVPCQPSTCVFSSCNTTCCVPSHCQPPHCQLVPSTCFIYQPVANCQAPCSTKNCCKPASCDTVISGQPTCDGPPSYNQSGCKSACCVTGLGTSPSSGSNCLPTSCQPSCESSFCKATLC

SEQ ID NO: 6739 - protein, 195 aa, Homo sapiens
MVSSCCGSVCSDQSCGQGLGQESCCRPSCCQTTCCRTTCCRPSCCISSCCRPSCCISSCCKPSCCRTTCCRPSCCISSCCRPSCCISSCCKPSCCRTTCCRPSCCISSCCRPSCCISSCCKPSCCQTTCCRPSCCISSCYRPQCCQPSCCRPACCISSCCHPSCCVSSCRCPFSCPTTCCRTTCFHPICCGSSCC

SEQ ID NO: 6740 - protein, 195 aa, Homo sapiens
MVNSCCGSVCSHQGCGRDLCQETCCRPSCCETTCCRTTYCRPSCCVSSCCRPQCCQSVCCQPTCCRPRCCISSCCRPSCCVSSCCKPQCCQSMCCQPTCCRPRCCISSCCRPSCCVSSCCRPQCCQSVCCQPTCCHPSCSISSCCRPSCCESSCCRPCCCLRPVCGRVSCHTTCYRPTCVISSCPRPLCCASSCC

SEQ ID NO: 6741 - protein, 210 aa, Homo sapiens
MVSSCCGSVCSDQGCGQDLCQETCCRPSCCETTCCRTTCCRPSCCVSSCCRPQCCQSVCCQPTCSRPSCCQTTCCRTTCYRPSCCVSSCCRPQCCQPACCQPTCCRPSCCETTCCHPRCCISSCCRPSCCVSSCCKPQCCQSVCCQPNCCRPSCSISSCCRPSCCESSCCRPCCCVRPVCGRVSCHTTCYRPTCVISSCPRPLCCASSCC

SEQ ID NO: 6742 - protein, 128 aa, Homo sapiens
MTGSCCGSTLSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCCRPPCGQPTPCSTTCRTSSC

SEQ ID NO: 6743 - protein, 128 aa, Homo sapiens
MTGSCCGSTFSSLSYGGGCCQPCCCRDPCCCRPVTCQTTVCRPVTCVPRCTRPICEPCRRPVCCDPCSLQEGCCRPITCCPSSCTAVVCRPCCWATTCCQPVSVQSPCCRPPCGQPTPCSTTCRTSSC

SEQ ID NO: 6744 - protein, 98 aa, Homo sapiens
MDCCASRGCSVPTGPATTICSSDKSCRCGVCLPSTCPHTVWLLEPTCCDNCPPPCHIPQPCVPTCFLLNSCQPTPGLETLNLTTFTQPCCEPCLPRGC

SEQ ID NO: 6745 - protein, 98 aa, Homo sapiens
MDCCASRSCSVPTGPATTICSSDKSCRCGVCLPSTCPHTVWLLEPICCDNCPPPCHIPQPCVPTCFLLNSCQPTPGLETLNLTTFTQPCCEPCLPRGC

SEQ ID NO: 6746 - protein, 98 aa, Homo sapiens
MYCCALRSCSVPTGPATTFCSFDKSCRCGVCLPSTCPHEISLLQPICCDTCPPPCCKPDTYVPTCWLLNNCHPTPGLSGINLTTYVQPGCESPCEPRC

SEQ ID NO: 6747 - protein, 96 aa, Homo sapiens
MCHTSCSSGCQPACCAPSPCQASCYIPVGCQSSVCVPVSFKPAVCVPVRCQSSVCVPVSCRPVVYAAPSCQSSGCCQPSCTSVLCRPISCSTPSCC

SEQ ID NO: 6748 - protein, 112 aa, Homo sapiens
MCHTSHSSGCPMACPGSPCCVPSTCYPPEGYGTSCCCSAPCVALLCRPLCGVSTCCQPACCVPSPCQVACCVPVSCKPVLCVASFCPTSGCCQPFCPTLVYRPVTWSTPTGC

SEQ ID NO: 6749 - protein, 221 aa, Homo sapiens
MATSTMSVCSSAYSDSWQVDACPESCCEPPCCATSCCAPAPCLTLVCTPVSCVSSPCCQAACEPSPCQSGCTSSCTPSCCQQSSCQPACCTSSPCQQACCVPVCCKPVCCVPVCCKPVCCKPICCVPVCSGASSSCCQQSSRQPACCTTSCCRPSSSVSLLCRPVCRSTCCVPIPSCCAPASTCQPSCCRPASCVSLLCRPTCSRLSSACCGLSSGQKSSC

SEQ ID NO: 6750 - protein, 255 aa, Homo sapiens
MAASTMSICSSACTNSWQVDDCPESCCELPCGTPSCCAPAPCLTLVCTPVSCVSSPCCQAACEPSACQSGCTSSCTPSCCQQSSCQPACCTSSPCQQACCVPVCCKPVCCVPVCCGASSCCQQSSCQPACCASSSCQQSCRVPVCCKAVCCVPTCSESSSSCCQQSSCQPACCTSSPCQQSCCVSVCCKPVCCKSICCVPVCSGASSPCCQQSSCQPACCTSSCCRPSSSVSLLCRPVCSRPASCSFSSGQKSSC

SEQ ID NO: 6751 - protein, 103 aa, Homo sapiens
MCGSYYRNYNGGHGYGCCGYGGLGCGYGGCGYGCCGYGGLGFGYGGLDCGYGGLGCGYGSFCGCGYRGLDCGYGCGYGYVSHSFCGCGYRCGSGYGSSFGYYY

SEQ ID NO: 6752 - protein, 1038 aa, Homo sapiens
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 6753 - protein, 253 aa, Homo sapiens
MELEQREGTMAAVGFEEFSAPPGSELALPPLFGGHILESELETEVEFVSGGLGGSGLRERDEEEEAARGRRRRQRELNRRKYQALGRRCREIEQVNERVLNRLHQVQRITRRLQQERRFLMRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEEDFGFEADEALDSSWVSRGPDKLLPYPTLASPASD

SEQ ID NO: 6754 - protein, 892 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLRPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWWLFGMDLNKMTHSRLAALRVTKPYLDIGC

SEQ ID NO: 6755 - protein, 1062 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLRPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 6756 - protein, 1004 aa, Homo sapiens
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 6757 - protein, 108 aa, Homo sapiens
MASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDED

SEQ ID NO: 6758 - protein, 256 aa, Homo sapiens; identical to SEQ ID NO: 5767

SEQ ID NO: 6759 - protein, 256 aa, Homo sapiens; identical to SEQ ID NO: 5767

SEQ ID NO: 6760 - protein, 256 aa, Homo sapiens; identical to SEQ ID NO: 5767

SEQ ID NO: 6761 - protein, 256 aa, Homo sapiens; identical to SEQ ID NO: 5767

SEQ ID NO: 6762 - protein, 276 aa, Homo sapiens
MSFEGGDGAGPAMLATGTARMASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 6763 - protein, 301 aa, Homo sapiens; identical to SEQ ID NO: 5683

SEQ ID NO: 6764 - protein, 203 aa, Homo sapiens [sequence omitted]

SEQ ID NO: 6765 - protein, 229 aa, Homo sapiens; identical to SEQ ID NO: 4809

SEQ ID NO: 6766 - protein, 760 aa, Homo sapiens
MMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEGSFGFSSDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 6767 - protein, 108 aa, Homo sapiens
MTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 6768 - protein, 424 aa, Homo sapiens
MVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 6769 - protein, 160 aa, Homo sapiens
MNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 6770 - protein, 308 aa, Homo sapiens
MMEEISIMVAYDAHVFSQLHDEDFLTSLVAISKPRSMVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 6771 - protein, 1199 aa, Homo sapiens; identical to SEQ ID NO: 4861

SEQ ID NO: 6772 - protein, 778 aa, Homo sapiens
RIQEQLESSFTGLTDEKVKAYLSLHPQVLDEFVSESVSAETVEKWLKRKNNKSEDESAPKEVSRYQDTNMQGVVYELNSYIEQRLDTGGDNQLLLYELSSIIKIATKADGFALYFLGECNNSLCIFTPPGIKEGKPRLIPAGPITQGTTVSAYVAKSRKTLLVEDILGDERFPRGTGLESGTRIQSVLCLPIVTAIGDLIGILELYRHWGKEAFCLSHQEVATANLAWASVAIHQVQVCRGLAKQTELNDFLLDVSKTYFDNIVAIDSLLEHIMIYAKNLVNADRCALFQVDHKNKELYSDLFDIGEEKEGKPVFKKTKEIRFSIEKGIAGQVARTGEVLNIPDAYADPRFNREVDLYTGYTTRNILCMPIVSRGSVIGVVQMVNKISGSAFSKTDENNFKMFAVFCALALHCANMYHRIRHSECIYRVTMEKLSYHSICTSEEWQGLMQFTLPVRLCKEIELFHFDIGPFENMWPGIFVYMVHRSCGTSCFELEKLCRFIMSVKKNYRRVPYHNWKHAVTVAHCMYAILQNNHTLFTDLERKGLLIACLCHDLDHRGFSNSYLQKFDHPLAALYSTSTMEQHHFSQTVSILQLEGHNIFSTLSSSEYEQVLEIIRKAIIATDLALYFGNRKQLEEMYQTGSLNLNNQSHRDRVIGLMMTACDLCSVTKLWPVTKLTANDIYAEFWAEGDEMKKLGIQPIPMMDRDKKDEVPQGQLGFYNAVAIPCYTTLTQILPPTEPLLKACRDNLSQWEKVIRGEETATWISSPSVAQKAAASED

SEQ ID NO: 6773 - protein, 426 aa, Homo sapiens; identical to SEQ ID NO: 6138

SEQ ID NO: 6774 - protein, 592 aa, Homo sapiens
MDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGGEDGLTGCLS

SEQ ID NO: 6775 - protein, 214 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGAWLAGPVPGSRAPRPGGNVGGTVEPRRPRSA

SEQ ID NO: 6776 - protein, 62 aa, Homo sapiens
MSIQWKTRQLQSKLHEADIVVLGSPKPEEIPLTWIQPGTTVLNCSHDFLSESLIIIRRMAIF

SEQ ID NO: 6777 - protein, 422 aa, Homo sapiens
MYPNPLIYCTCWDPWNLGPRKLIKTPQLPRKNSTGSSKLTPLVPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 6778 - protein, 459 aa, Homo sapiens
MVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVASSEPFSGQVNSQLNCSVNGSSSYHSDDDDDDDDDDDDDNIDDDDGDNDHEALGVGDNSIPTIYFSHTVEPKRVRINTGKNTTLKFSEKKEEAKRKRKNSTGSGHSAQELPTIRTPADIYRAFVDVVNGEYVPRKSILKSRSRENSVCSDTSESSAAEFDDRRGVLRSISCEEATCSDTSESILEEEPQENQKKLLPLSVTPEAFSGTVIEKEFVSPSLTPPPAIAHPALPTIPERKEVLLEASEETGKRVSKFKAARLQQKD

SEQ ID NO: 6779 - protein, 355 aa, Homo sapiens
MREIVHIQAGQCGNQIGAKFWEVISDEHGIDPTGSYHGDSDLQLLTHSLGGGTGSGMGTLLISKIREEYPDRIMNTFSVMPSPKVSDTVVEPYNATLSVHQLVENTDETYSIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 6780 - protein, 84 aa, Homo sapiens; identical to SEQ ID NO: 5781

SEQ ID NO: 6781 - protein, 471 aa, Homo sapiens
MKMQVFCKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQVMIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 6782 - protein, 533 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKT

SEQ ID NO: 6783 - protein, 556 aa, Homo sapiens
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKGTKKKKGLDSMTSTVAAGWLDRRV

SEQ ID NO: 6784 - protein, 102 aa, Homo sapiens
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMRRK

SEQ ID NO: 6785 - protein, 204 aa, Homo sapiens
MEAEPKGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 6786 - protein, 122 aa, Homo sapiens
  MOD_RES (1)..(1): Any amino acid
XYLVALGCIKPLCDLLTVMDSKIVQVALNGLENILRLGEQESKQNGIGINPYCALIEEAYGLDKIEFLQSHENQEIYQKAFDLIEHYFGVEEDDPSIVPQVDENQQQFIFQQQEAPMDGFQL

SEQ ID NO: 6787 - protein, 378 aa, Homo sapiens
MEVKPPPGRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 6788 - protein, 1020 aa, Homo sapiens
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYCQWPVSSEAQQPEPLRSLVPYGPFPCKAITRILWLTTRQGLPFTIFQGGMPRASYGDRHCISVIHDGQQTAFDFTSRVIGFTVLTEADPAATFDDPYALVVLAEEELVVIDLQTAGWPPVQLPYLASLHCSAITCSHHVSNIPLKLWERIIAAGSRQNAHFSTMEWPIDGGTSLTPAPPQRDLLLTGHEDGTVRFWDASGVCLRLLYKLSTVRVFLTDTDPNENFSAQGEDEWPPLRKVGSFDPYSDDPRLGIQKIFLCKYSGYLAVAGTAGQVLVLELNDEAAEQAVEQVEADLLQDQEGYRWKGHERLAARSGPVRFEPGFQPFVLVQCQPPAVVTSLALHSEWRLVAFGTSHGFGLFDHQQRRQVFVKCTLHPSDQLALEGPLSRVKSLKKSLRQSFRRMRRSRVSSRKRHPAGPPGEAQEGSAKAERPGLQNMELAPVQRKIEARSAEDSFTGFVRTLYFADTYLKDSSRHCPSLWAGTNGGTIYAFSLRVPPAERRMDEPVRAEQAKEIQLMHRAPVVGILVLDGHSVPLPEPLEVAHDLSKSPDMQGSHQLLVVSEEQFKVFTLPKVSAKLKLKLTALEGSRVRRVSVAHFGSRRAEDYGEHHLAVLTNLGDIQVVSLPLLKPQVRYSCIRREDVSGIASCVFTKYGQGFYLISPSEFERFSLSTKWLVEPRCLVDSAETKNHRPGNGAGPKKAPSRARNSGTQSDGEEKQPGLVMERALLSDERVLKEIQSTLEGDRGSGNWRSHRAAVGCSLSNGGAE

SEQ ID NO: 6789 - protein, 485 aa, Homo sapiens
MAAELYAPASAAAADLANSNAGAAVGRKAGPRSPPSAPAPAPPPPAPAPPTLGNNHQESPGWRCCRPTLRERNALMFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 6790 - protein, 960 aa, Homo sapiens; identical to SEQ ID NO: 4904

SEQ ID NO: 6791 - protein, 222 aa, Homo sapiens
MERIEGASVGRCAASPYLRPLTLHYRQNGAQKSWDFMKTHDSVTVLLFNSSRRSLVLVKQFRPAVYAGEVERRFPGSLAAVDQDGPRELQPALPGSAGVTVELCAGLVDQPGLSLEEVACKEAWEECGYHLAPSDLRRVATYWSGVGLTGSRQTMFYTEVTDAQRSGPGGGLVEEGELIEVVHLPLEGAQAFADDPDIPKTLGVIFGVSWFLSQVAPNLDLQ

SEQ ID NO: 6792 - protein, 291 aa, Homo sapiens
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRTLFI

SEQ ID NO: 6793 - protein, 209 aa, Homo sapiens; identical to SEQ ID NO: 4887

SEQ ID NO: 6794 - protein, 167 aa, Homo sapiens
MPAYHSSLMDPDTKLIGNMALLPIRSQFKGPAPRETKDTDIVDEAIYYFKANVFFKNYEIKNEADRTLIYITLYISECLKKLQKCNSKSQGEKEMYTLGITNFPIPGEPGFPLNAIYAKPANKQEDEVMRAYLQQLRQETGLRLCEKVIKGDLKFSAALKLALNKNK

SEQ ID NO: 6795 - protein, 1357 aa, Homo sapiens; identical to SEQ ID NO: 6044

SEQ ID NO: 6796 - protein, 95 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLGYHS

SEQ ID NO: 6797 - protein, 235 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKTQDWKPA

SEQ ID NO: 6798 - protein, 362 aa, Homo sapiens; identical to SEQ ID NO: 5396

SEQ ID NO: 6799 - protein, 425 aa, Homo sapiens; identical to SEQ ID NO: 4868

SEQ ID NO: 6800 - protein, 212 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKEQGLRPYLLIHDGVRSEFDQIDTSNPNCVVIADAGESFSYQNMNNAFQVLMELEKPVLISLGKGRYYKETSGLMLDVGPYMKALEYACGIKAEVVGKPSPEFFKSALQAIGVEAHQLLSV

SEQ ID NO: 6801 - protein, 955 aa, Homo sapiens
MEVGSEEEKWEKLDAEFDHFVVDMKPFVLKLPHRTERQRCALWIRKLCEPSGTGAGIMGRKNRNLYAKLLLHMLKRGALEGPFTHRPEPGTLKILPSYMSIYFDEPNPARAKGSSPEGLPAWVLGELETSEHKLNESWKLSSGEDNTLVQSPTDVYSREQYTGKLRVRSHSLSPTHREDGQNITPKICEVYSKKSPVSLDDSDIEARLNSWNLGIENPRYLRQKPIPVSLMTPKFSLRKSSSFHDDHFLSRIREKELDMKTKMMEAKFHEEKLKLQQKHDADVQKILERKNNEIEELKTLYRSKQHETEETIRKLEKKVQTLIRDCQVIRETKEDQIAELKKICEQSTESLNNDWEKKLHNAVAEMEQEKFDLQKQHTENIQELLEDTNVRLNKMESEYMAQTQSTNHMIKELEARVQQLTGEAENSNLQRQKLIQEKAELERCYQITCSELQEVKARRNTLHKEKDHLVNDYEQNMKLLQTKYDADINLLKQEHALSASKASSMIEELEQNVCQLKQQLQESELQRKQQLRDQENKFQMEKSHLKHIYEKKAHDLQSELDKGKEDTQKKIHKFEEALKEKEEQLTRVTEVQRLQAQQADAALEEFKRQVELNSEKVYAEMKEQMEKVEADLTRSKSLREKQSKEFLWQLEDIRQRYEQQIVELKLEHEQEKTHLLQQHNAEKDSLVRDHEREIENLEKQLRAANMEHENQIQEFKKRDAQVIADMEAQVHKLREELINVNSQRKQQLVELGLLREEEKQRATREHEIVVNKLKAESEKMKIELKKTHAAETEMTLEKANSKLKQIEKEYTQKLAKSSQIIAELQTTISSLKEENSQQQLAAERRLQDVRQKFEDEKKQLIRDNDQAIKVLQDELENRSNQVRCAEKKLQHKELESQEQITYIRQEYETKLKGLMPASLRQELEDTISSLKSQVNFLQKRASILQEELTTYQGRR

SEQ ID NO: 6802 - protein, 422 aa, Homo sapiens
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKTGETTSKRKK

SEQ ID NO: 6803 - protein, 100 aa, Homo sapiens
MRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFR

SEQ ID NO: 6804 - protein, 352 aa, Homo sapiens
MGKVENSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 6805 - protein, 498 aa, Homo sapiens
MVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQ

SEQ ID NO: 6806 - protein, 649 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENFFPFHFGFEGVLPLAGVTLSTKARDPK

SEQ ID NO: 6807 - protein, 278 aa, Homo sapiens; identical to SEQ ID NO: 5072

SEQ ID NO: 6808 - protein, 455 aa, Homo sapiens
MFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6809 - protein, 652 aa, Homo sapiens
  MOD_RES (1)..(1): Any amino acid
XSHAFISQWVCRHWRDPVAHPQDPHHPSEKPVIHCHKCGEPCKGEVLRVQTKHFHIKCFTCKVCGCDLAQGGFFIKNGEYLCTLDYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 6810 - protein, 278 aa, Homo sapiens
MTQQWREVNEDREAVAQARSWQSLNLGDRDMGVSFIETALALSAARARRPLLTSHPPSRPFQPPKHTPSPPPAPRVNSRHPGRSVSLSLPSASQAPPVPLASPEGRPHTVGAPHASTWKRTRGRQRARPPKIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 6811 - protein, 179 aa, Homo sapiens
MTDLVAVWDVALSDGVHKIEFEHGTTSGKRVVYVDGKEEIRKEWMFKLVGKETFYVGAAKTKATINIDAISGFAYEYTLEINGKSLKKYMEDRSKTTNTWVLHMDGENFRIVLEKDAMDVWCNGKKLETAGEFVDDGTETHFSIGNHDCYIKAVSSGKRKEGIIHTLIVDNREIPEIAS

SEQ ID NO: 6812 - protein, 179 aa, Homo sapiens; identical to SEQ ID NO: 6811

SEQ ID NO: 6813 - protein, 350 aa, Homo sapiens
MGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEAVKYRPRAAGGLCLKTSTEKVCAVWSDDLRRA

SEQ ID NO: 6814 - protein, 666 aa, Homo sapiens
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRSLQGPQWQSVEEAFPHIYSHGCVLKDVCSECTSFVADVVRSSRKSVDVLNTTPRRSRQTQSLYIPNTRTLDFK

SEQ ID NO: 6815 - protein, 157 aa, Homo sapiens
METLQSETKTRVLPSWLTAQVATKNVAPMKAPKRMRMAAVPVAAARLPATRTVYCMNEAEIVDVALGILIESRKQEKACEQPALAGADNPEHSPPCSVSPHTSSGSSSEEEDSGKQALAPGLSPSQRPGGSSSACSRSPEEEEEEDVLKYVREIFFS

SEQ ID NO: 6816 - protein, 267 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 6817 - protein, 292 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 6818 - protein, 163 aa, Homo sapiens
MKSSQTFEEQTECIVNTLLMDFLSPTLQVASRNLCCVDEVDSGEPCSFDVAIIAGRLRMLGDQFNGELEASAKNVIAETIKGQTGAILQDTVESLSKTWCAQDSSLAYERAFLAVSVKLLEYMAHIAPEVVGQVAIPMTGMINGNQAIREFIQGQGGWENLES

SEQ ID NO: 6819 - protein, 185 aa, Homo sapiens; identical to SEQ ID NO: 4734

SEQ ID NO: 6820 - protein, 449 aa, Homo sapiens; identical to SEQ ID NO: 5907

SEQ ID NO: 6821 - protein, 246 aa, Homo sapiens
MSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 6822 - protein, 9 aa, Homo sapiens
MSYYQRPFS

SEQ ID NO: 6823 - protein, 666 aa, Homo sapiens
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPTDRINPDDIDLENEPWYKFFSELEFGRPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 6824 - protein, 823 aa, Homo sapiens
MTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLNSLVLKKGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 6825 - protein, 987 aa, Homo sapiens
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVENLTRELENGEKQQLQMLDRLKEIQNHFDTCEAERKHADLQISELTRHAEDATKQAERYLSELQQSEALKEEAEKRREDLKLKAQESIRQWKLKHKKLERALEKQSETVDELTGKNNQILKEKDELKTQLYAALQQIENLRKELNDVLTKRALQEEELHSKEEKLRDIKSHQADLELEVKNSLDTIHRLESELKKQSKIQSQMKVEKAHLEEEIAELKKSQAQDKAKLLEMQESIKDLSAIRADLANKLAEEERAKKAVLKDLSDLTAQAKSRDEETATIITQLKLERDVHQRELKDLTSSLQSVKTKHEQNIQELMKHFKKEKSEAENHIRTLKAESLEEKNMAKIHRGQLEKLKSQCDRLTEELTQNENENKKLKLKYQCLKDQLEEREKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVPEKLSLLEDFKDFRR

SEQ ID NO: 6826 - protein, 1718 aa, Homo sapiens
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEKVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQIQLFAPAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 6827 - protein, 699 aa, Homo sapiens
MSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 6828 - protein, 370 aa, Homo sapiens
MGFNRPSKIQENALPLMLAEPPQNLIAQSQSGTGKTAAFVLAMLSQVEPANKYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 6829 - protein, 879 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKRLLGGCSEEGKLSTSQDAACKDAEECPETAEAKCAAPRPPSSSPEQRTGQPSAPGDTSVNGPV

SEQ ID NO: 6830 - protein, 873 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 6831 - protein, 879 aa, Homo sapiens
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKRVLKSYREEGKLSTSQDAACKDAEECPETAEAKCAAPRPPSSSPEQRTGQPSAPGDTSVNGPV

SEQ ID NO: 6832 - protein, 377 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASASKAS

SEQ ID NO: 6833 - protein, 191 aa, Homo sapiens; identical to SEQ ID NO: 5282

SEQ ID NO: 6834 - protein, 191 aa, Homo sapiens; identical to SEQ ID NO: 5282

SEQ ID NO: 6835 - protein, 189 aa, Homo sapiens
MGKSCKVVVCGQASVGKTSILEQLLYGNHVVAMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 6836 - protein, 191 aa, Homo sapiens; identical to SEQ ID NO: 5282

SEQ ID NO: 6837 - protein, 334 aa, Homo sapiens
MAEEVRREEASGVGRARTPTPGALRAPQLVTEAPPLHPGHTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSACENSGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 6838 - protein, 176 aa, Homo sapiens; identical to SEQ ID NO: 5124

SEQ ID NO: 6839 - protein, 303 aa, Homo sapiens
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGF

SEQ ID NO: 6840 - protein, 622 aa, Homo sapiens
MDLLTRENVALKVESAQQPKQVLKMEVAVLKKLQGKDHVCRFIGCGRNEKFNYVVMQLQGRNLADLRRSQPRGTFTLSTTLRLGKQILESIEAIHSVGFLHRDIKPSNFAMGRLPSTYRKCYMLDFGLARQYTNTTGDVRPPRNVAGFRGTVRYASVNAHKNREMGRHDDLWSLFYMLVEFAVGQLPWRKIKDKEQVGMIKEKYEHRMLLKHMPSEFHLFLDHIASLDYFTKPDYQLIMSVFENSMKERGIAENEAFDWEKAGTDALLSTSTSTPPQQNTRQTAAMFGVVNVTPVPGDLLRENTEDVLQGEHLSDQENAPPILPGRPSEGLGPSPHLVPHPGGPEAEVWEETDVNRNKLRINIGKSPCVEEEQSRGMGVPSSPVRAPPDSPTTPVRSLRYRRVNSPESERLSTADGRVELPERRSRMDLPGSPSRQACSSQPAQMLSVDTGHADRQASGRMDVSASVEQEALSNAFRSVPLAEEEDFDSKEWVIIDKETELKDFPPGAEPSTSGTTDEEPEELRPLPEEGEERRRLGAEPPFPLTPALGTPPSTERVGPHRPTETVGGGQTLGALPPAVQPPATTGVLRVLLLHAGDGALPSPRRRRLLGLLRFPHSAQPLG

SEQ ID NO: 6841 - protein, 148 aa, Homo sapiens
MAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRGEHPKPPSWLSMDPALSSFPGGL

SEQ ID NO: 6842 - protein, 201 aa, Homo sapiens
MVNSCCGSVCSDQGCGLENCCRPSCCQTTCCRTTCCRPSCCVSSCCRPQCCQSVCCQPTCCRPSCCQTTCCRTTCCRPSCCVSSCCRPQCCQSVCCQPTCCRPSCCQTTCCRTTCCRPSCCVSSCCRPQCCQSVCCQPTCCRPSCCISSSCCPSCCESSCCRPCCCLRPVCGRVSCHTTCYRPTCVISTCPRPLCCASSCC

SEQ ID NO: 6843 - protein, 128 aa, Homo sapiens; identical to SEQ ID NO: 6742

SEQ ID NO: 6844 - protein, 379 aa, Homo sapiens
MSLRLSSASRRSCPRPTTGSLRLYGGGTSFGTGNSCGISGIGSGFSSAFGGSSSGGNTGGGNPCAGFTVNERGLLSGNEKVTMQNLNDRLASYLDSVHALEEANADLEQKIKGWYEKFGPGSCRGLDHDYSRYFPIIDDLKNQIIASTTSNANAVLQIDNARLTADDFRLKYENELALHQSVEADVNGLRRVLDEITLCRTDLEIQYETLSEEMTYLKKNHKEEMQVLQCAAGGNVNVEIELQSLLATKHSLECSLTETESNYCAQLAQIQAQIGALEEQLHQVRTETEGQKLEYEQLLDIKLHLEKEIETYCLLIGGDDGACKSGGYKSKDYGSGNVGSQVKDPAKAIVVKKVLEEVDQRSKILTTRLHSLEEKSQSN

SEQ ID NO: 6845 - protein, 255 aa, Homo sapiens
MDKDEEALKAAQAELKEARRQWHHLQVEIESLHAVERGLENSLHASEQHYQMQLQDLETVIEGLEKELQEVRRGIEKQLQEHEMLLNTKMRLEQEIATYRHLLEKEEIRYYGCIQGGKKDKKPTTSRVGFVLPSAIINEISFTTKVPQKYENENVETVTKQAILNGSIVKESTEAHGTIQTEKVDEVIKEWEGSFFKDNPRLRKKSVSLRFDLHLAATDEGCLETKQDNLPDIEVRLIMRRSCSIPSIKPPSTAN

SEQ ID NO: 6846 - protein, 295 aa, Homo sapiens
MELSQLLNEIRANYEKILTRNQIETVLSTRIQLEEDISKKMDKDEEALKAAQAELKEARRQWHHLQVEIESLHAVERGLENSLHASEQHYQMQLQDLETVIEGLEKELQEVRRGIEKQLQEHEMLLNTKMRLEQEIATYRHLLEKEEIRYYGCIQGGKKDKKPTTSRVGFVLPSAIINEISFTTKVPQKYENENVETVTKQAILNGSIVKESTEAHGTIQTEKVDEVIKEWEGSFFKDNPRLRKKSVSLRFDLHLAATDEGCLETKQDNLPDIEVRLIMRRSCSIPSIKPPSTAN

SEQ ID NO: 6847 - protein, 619 aa, Homo sapiens; identical to SEQ ID NO: 5804

SEQ ID NO: 6848 - protein, 619 aa, Homo sapiens; identical to SEQ ID NO: 5804

SEQ ID NO: 6849 - protein, 389 aa, Homo sapiens [sequence omitted]

SEQ ID NO: 6850 - protein, 182 aa, Homo sapiens
MPIPPPPPPPPGPPPPPTFHQANTEQPKLSRDEQRGRGALLQDICKGTKLKKVTNINDRSAPILETPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 6851 - protein, 276 aa, Homo sapiens
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 6852 - protein, 491 aa, Homo sapiens; identical to SEQ ID NO: 4824

SEQ ID NO: 6853 - protein, 362 aa, Homo sapiens
MAHSSFFPDEYFTCSSLCLSCGVGCKKSMNHGKEGVPHEAKSRCRYSHQYDNRVYTCKACYERGEEVSVVPKTSASTDSPWMGLAKYAWSGYVIECPNCGVVYRSRQYWFGNQDPVDTVVRTEIVHVWPGTDGFLKDNNNAAQRLLDGMNFMAQSVSELSLGPTKAVTSWLTDQIAPAYWRPNSQILSCNKCATSFKDNDTKHHCRACGEGFCDSCSSKTRPVPERGWGPAPVRVCDNCYEARNVQLAVTEAQVDDEGGTLIARKVGEAVQNTLGAVVTAIDIPLGLVKDAARPAYWVPDHEILHCHNCRKEFSIKLSKHHCRACGQGFCDECSHDRRAVPSRGWDHPVRVCFNCNKKPGDL

SEQ ID NO: 6854 - protein, 115 aa, Homo sapiens
MSGEPGQTSVAPPPEEVEPGSGVRIVVEYCEPCGFEATYLELASAVKEQYPGIEIESRLGGTGAFEIEINGQLVFSKLENGGFPYEKDLIEAIRRASNGETLEKITNSRPPCVIL

SEQ ID NO: 6855 - protein, 168 aa, Homo sapiens
MLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 6856 - protein, 168 aa, Homo sapiens; identical to SEQ ID NO: 6855

SEQ ID NO: 6857 - protein, 215 aa, Homo sapiens
MDPKDRKKIQFSVPAPPSQLDPRQVEMIRRRRPTPAMLFRLSEHSSPEEEASPHQVTPLTWHFPWQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 6858 - protein, 1722 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEESASPPPKECSSSPAMEQSWKENDFDKLREEGFRRSNYSELQEEIQTKGKEVENFEKNLD

SEQ ID NO: 6859 - protein, 404 aa, Homo sapiens
MRRDVNGVTKSRFEMFSNSDEAVINKKLPKELLLRIFSFLDVVTLCRCAQVSRAWNVLALDGSNWQRIDLFDFQRDIEGRVVENISKRCGGFLRKLSLRGCLGVGDNALRTFAQNCRNIEVLNLNGCTKTTDAEGCPLLEQLNISWCDQVTKDGIQALVRGCGGLKALFLKGCTQLEDEALKYIGAHCPELVTLNLQTCLQITDEGLITICRGCHKLQSLCASGCSNITDAILNALGQNCPRLRILEVARCSQLTDVGFTTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRTHLPNIKVHAYFAPVTPPPSVGGSRQRFCRCCIIL

SEQ ID NO: 6860 - protein, 416 aa, Homo sapiens
MAHSPVAVQVPGMQNNIADPEELFTKLERIGKGSFGEVFKGIDNRTQQVVAIKIIDLEEAEDEIEDIQQEITVLSQCDSSYVTKYYGSYLKGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 6861 - protein, 339 aa, Homo sapiens
MAHSPVAVQVPGMQGSKLWIIMEYLGGGSALDLLRAGPFDEFQIATMLKEILKGLDYLHSEKKIHRDIKAANVLLSEQGDVKLADFGVAGQLTDTQIKRNTFVGTPFWMAPEVIQQSAYDSKADIWSLGITAIELAKGEPPNSDMHPMRVLFLIPKNNPPTLVGDFTKSFKEFIDACLNKDPSFRPTAKELLKHKFIVKNSKKTSYLTELIDRFKRWKAEGHSDDESDSEGSDSESTSRENNTHPEWSFTTVRKKPDPKKVQNGAEQDLVQTLSCLSMIITPAFAELKQQDENNASRNQAIEELEKSIAVAEAACPGITDKMVKKLIEKFQKCSADESP

SEQ ID NO: 6862 - protein, 874 aa, Homo sapiens; identical to SEQ ID NO: 6021

SEQ ID NO: 6863 - protein, 482 aa, Homo sapiens
MEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 6864 - protein, 1259 aa, Homo sapiens
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPGVGVFPSQDPAQPRMPPWIYNESLVPDAYKKILETTMTPTGIDTAKLYPILMSSGLPRETLGQIWALANRTTPGKLTKEELYTVLAMIAVTQRGVPAMSPDALNQFPAAPIPTLSGFSMTLPTPVSQPTVIPSGPAGSMPLSLGQPVMGINLVGPVGGAAAQASSGFIPTYPANQVVKPEEDDFQDFQDASKSGSLDDSFSDFQELPASSKTSNSQHGNSAPSLLMPLPGTKALPSMDKYAVFKGIAADKSSENTVPPGDPGDKYSAFRELEQTAENKPLGESFAEFRSAGTDDGFTDFKTADSVSPLEPPTKDKTFPPSFPSGTIQQKQQTQVKNPLNLADLDMFSSVNCSSEKPLSFSAVFSTSKSVSTPQSTGSAATMTALAATKTSSLADDFGEFSLFGEYSGLAPVGEQDDFADFMAFSNSSISSEQKPDDKYDALKEEASPVPLTSNVGSTVKGGQNSTAASTKYDVFRQLSLEGSGLGVEDLKDNTPSGKSDDDFADFHSSKFSSINSDKSLGEKAVAFRHTKEDSASVKSLDLPSIGGSSVGKEDSEDALSVQFDMKLADVGGDLKHVMSDSSLDLPTVSGQHPPAADIEDLKYAAFGSYSSNFAVSTLTSYDWSDRDDATQGRKLSPFVLSAGSGSPSATSILQKKETSFGSSENITMTSLSKVTTFVSEDALPETTFPALASFKDTIPQTSEQKEYENRDYKDFTKQDLPTAERSQEATCPSPASSGASQETPNECSDDFGEFQSEKPKISKFDFLVATSQSKMKSSEEMIKSELATFDLSVQGSHKRSLSLGDKEISRSSPSPALEQPFRDRSNTLNEKPALPVIRDKYKDLTGEVEENERYAYEWQRCLGSALNVIKKANDTLNGISSSSVCTEVIQSAQGMEYLLGVVEVYRVTKRVELGIKATAVCSEKLQQLLKDIDKVWNNLIGFMSLATLTCCWEKMTVITKHLSPYHELLEEKPDENSLDFSSCMLRPGIKNAQELACGVCLLNVDSRSRKEEKPAEEHPKKAFNSETDSFKLAYGGHQYHASCANFWINCVEPKPPGLVLPDLL

SEQ ID NO: 6865 - protein, 385 aa, Homo sapiens
MALRPGAGSGGGGAAGAGAGSAGGGGFMFPVAGGIRPPQAGLMPMQQQGFPMVSVMQPNMQGIMGMNYSSQMSQGPIAMQAGIPMGPMPAAGMPYLGQAPFLGMRPPGPQYTPDMQKQFAEEQQKRFEQQQKLLEEERKRRQFEEQKQKLRLLSSVKPKTGEKSRDDALEAIKGNLDGFSRDAKMHPTPASHPKKPDCPTSSHSTKTVSPSPAFLDEEEFSDFMQGPVEVPPCGPSSTSQPFQSFHPSTPLGQLHTQKAGTQPLPPSQSPVPFALHGVPGQIPYFSTASASHSVPEAGPSLEEKFLVSCDISTSGQEQIKLNTSEVGHKALGPGSSKKYPSLMASNGVAVDGCVWEYFPHRILLSPECLLGFTMRVWFQMPIRKS

SEQ ID NO: 6866 - protein, 312 aa, Homo sapiens
MADFGISAGQFVAVVWDKSSPVEALKGLVDKLQALTGNEGRVSVENIKQLLQSAHKESSFDIILSGLVPGSTTLHSAEILAEIARILRPGGCLFLKEPVETAVDNNSKVKTASKLCSALTLSGLVEVKELQREPLTPEEVQSVREHLGHESDNLLFVQITGKKPNFEVGSSRQLKLSITKKSSPSVKPAVDPAAAKLWTLSANDMEDDSMDLIDSDELLDPEDLKKPDPASLRAASCGEGKKRKACKNCTCGLAEELEKEKSREQMSSQPKSACGNCYLGDAFRCASCPYLGMPAFKPGEKVLLSDSNLHDA

SEQ ID NO: 6867 - protein, 351 aa, Homo sapiens
MNESNDSTNYDMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 6868 - protein, 137 aa, Homo sapiens; identical to SEQ ID NO: 5914

SEQ ID NO: 6869 - protein, 931 aa, Homo sapiens; identical to SEQ ID NO: 4998

SEQ ID NO: 6870 - protein, 105 aa, Homo sapiens [sequence omitted]

SEQ ID NO: 6871 - protein, 220 aa, Homo sapiens
MNSMDRHIQQTNDRLQCIKQHLQNPANFHNAATELLDWCGDPRAFQRPFEQSLMGCLTVVSRVAAQQGFDLDLGYRLLAVCAANRDKFTPKSAALLSSWCEELGRLLLLRHQKSRQSDPPGKLPMQPPLSSMSSMKPTLSHSDGSFPYDSVPWLPAYPACTPPPSQSHPNSCSLKQKQPLAFPPPLCSIWLTTLQGLLGSLSCVHFVSGWSVPREPHGLG

SEQ ID NO: 6872 - protein, 117 aa, Homo sapiens [sequence omitted]

SEQ ID NO: 6873 - protein, 117 aa, Homo sapiens [sequence omitted]

SEQ ID NO: 6874 - protein, 117 aa, Homo sapiens [sequence omitted]

SEQ ID NO: 6875 - protein, 633 aa, Homo sapiens; identical to SEQ ID NO: 6010

SEQ ID NO: 6876 - protein, 546 aa, Homo sapiens
MKAIKKSLTEEEYLYLDFSHQTEGCIFPLHTSVTLFLLSYCDCKIFKICLVVTKEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 6877 - protein, 513 aa, Homo sapiens
MLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDHFTGAIEKLTSQIRDQEAKLSETISASNAWKSHYEKIVIEKTELEVQIETMKKQIINLLEDLKKMEDHGKNSCEEILRKVHSIEYENETLNLENTKLKTTLAALKDEVVSVENELSELQEVEKKQKTLIEMYKTQVQKLQEAAEIVKSRCENLLHKNNQITKTKNKNVEKMRGQMESHLKELERVCDSLTAAERRLHECQESLQCCKGKCADQEHTIRELQGQVDGNHNLLTKLSLEEENCLIQLKCENLQQKLEQMDAENKELEKKLANQEECLKHSNLKFKEKSAEYTALARQLEAALEEGRQKVAEEIEKMSSRESALQIKILDLETELRKKNEEQNQLVCKMNSKAQHQEVCLKEVQNSLEKSENQNESIKNYLQFLKTSYVTMFE

SEQ ID NO: 6878 - protein, 388 aa, Homo sapiens
MAAAAALARLEQKQSRAWGPTSQDTIRNQVRKELQAEATVSGSPEAPGTNVVSEPREEGSAHLAVPGVYFTCPLTGATLRKDQRDACIKEAILLHFSTDPVAASIMKIYTFNKDQDRVKLGVDTIAKYLDNIHLHPEEEKYRKIKLQNKVFQERINCLEGTHEFFEAIGFQKVLLPAQDQEDPEEFYVLSETTLAQPQSLERHKEQLLAAEPVRAKLDRQRRVFQPSPLASQFELPGDFFNLTAEEIKREQRLRSEAVERLSVLRTKAMREKEEQRGLRKYNYTLLRVRLPDGCLLQGTFYARERLGAVYGFVREALQSDWLPFELLASGGQKLSEDENLALNECGLVPSALLTFSWDMAVLEDIKAAGAEPDSILKPELLSAIEKLL

SEQ ID NO: 6879 - protein, 896 aa, Homo sapiens
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 6880 - protein, 977 aa, Homo sapiens
MGAEEEVLVTLSGGAPWGFRLHGGAEQRKPLQVSKIRRRSQAGRAGLRERDQLLAINGVSCTNLSHASAMSLIDASGNQLVLTVQRLADEGPVQSPSPHELQVLSPLSPLSPEPPGAPVPQPLQPGSLRSPPDSEAYYGETDSDADGPATQEKPRRPRRRGPTRPTPPGAPPDEVYLSDSPAEPAPTIPGPPSQGDSRVSSPSWEDGAALQPPPAEALLLPHGPLRPGPHLIPMVGPVPHPVAEDLTTTYTQKAKQAKLQRAESLQEKSIKEAKTKCRTIASLLTAAPNPHSKGVLMFKKRRQRAKKYTLVSFGAAAGTGAEEEDGVPPTSESELDEEAFSDARSLTNQSDWDSPYLDMELARAGSRASEGQGSGLGGQLSEVSGRGVQLFEQQRQRADSSTQELARVEPAAMLNGEGLQSPPRAQSAPPEAAVLPPSPLPAPVASPRPFQPGGGAPTPAPSIFNRSARPFTPGLQGQRPTTTSVIFRPLAPKRANDSLGGLSPAPPPFLSSQGPTPLPSFTSGVPSHAPVSGSPSTPRSSGPVTATSSLYIPAPSRPVTPGGAPEPPAPPSAAAMTSTASIFLSAPLRPSARPEAPAPGPGAPEPPSAREQRISVPAARTGILQEARRRGTRKQMFRPGKEETKNSPNPELLSLVQNLDEKPRAGGAESGPEEDALSLGAEACNFMQPVGARSYKTLPHVTPKTPPPMAPKTPPPMTPKTPPPVAPKPPSRGLLDGLVNGAASSAGIPEPPRLQGRGGELFAKRQSRADRYVVEGTPGPGLGPRPRSPSPTPSLPPSWKYSPNIRAPPPIAYNPLLSPFFPQAARTLPKAQSQGPRATPKQGIKALDFMRHQPYQLKTAMFCFDEVPPTPGPIASGSPKTARVQEIRRFSTPAPQPTAEPLAPTVLAPRAATTLDEPIWRTELASAPVPSPAPPPEAPRGLGASPSSCGFQVARPRFSATRTGLQAHVWRPGAGHQ

SEQ ID NO: 6881 - protein, 918 aa, Homo sapiens
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKCSFVEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWLQQEEEERRHQELLQKKKEEEQERLRKAAEAKRLAEQREQERREQERREQERREQERREQERREQERQLAEQERRREQERLQAERELQEREKALRLQKEQLQRELEEKKKKEEQQRLAERQLQEEQEKKAKEAAGASKALNVTVDVQSPACTSYQMTPQGHRAPPKINPDNYGMDLNSDDSTDDEAHPRKPIPTWARGTPLSQAIIHQYYHPPNLLELFGTILPLDLEDIFKKSKPRYHKRTSSAVWNSPPLQGARVPSSLAYSLKKH

SEQ ID NO: 6882 - protein, 575 aa, Homo sapiens
MTSKKLVNSVAGCADDALAGLVACNPNLQLLQGHRVALRSDLDSLKGRVALLSGGGSGHEPAHAGFIGKGMLTGVIAGAVFTSPAVGSILAAIRAVAQAGTVGTLLIVKNYTGDRLNFGLAREQARAEGIPVEMVVIGDDSAFTVLKKAGRRGLCGTVLIHKVAGALAEAGVGLEEIAKQVNVVAKAMGTLGVSLSSCSVPGSKPTFELSADEVELGLGIHGEAGVRRIKMATADEIVKLMLDHMTNTTNASHVPVQPGSSVVMMVNNLGGLSFLELGIIADATVRSLEGRGVKIARALVGTFMSALEMPGISLTLLLVDEPLLKLIDAETTAAAWPNVAAVSITGRKRSRVAPAEPQEAPDSTAAGGSASKRMALVLERVCSTLLGLEEHLNALDRAAGDGDCGTTHSRAARAIQEWLKEGPPPASPAQLLSKLSVLLLEKMGGSSGALYGLFLTAAAQPLKAKTSLPAWSAAMDAGLEAMQKYGKAAPGDRTMLDSLWAAGQELQAWKSPGADLLQVLTKAVKSAEAAAEATKNMEAGAGRASYISSARLEQPDPGAVAAAAILRAILEVLQS

SEQ ID NO: 6883 - protein, 359 aa, Homo sapiens
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLTVSILEQRLTLTEDKLKQCLENQQLIMQRATP

SEQ ID NO: 6884 - protein, 210 aa, Homo sapiens; identical to SEQ ID NO: 6033

SEQ ID NO: 6885 - protein, 496 aa, Homo sapiens
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKVKWESVSVLNLFTRIR

SEQ ID NO: 6886 - protein, 129 aa, Homo sapiens; identical to SEQ ID NO: 6440

SEQ ID NO: 6887 - protein, 295 aa, Homo sapiens; identical to SEQ ID NO: 5678

SEQ ID NO: 6888 - protein, 295 aa, Homo sapiens; identical to SEQ ID NO: 5678

SEQ ID NO: 6889 - protein, 117 aa, Homo sapiens
MLCWGNASFGQLGLGGIDEEIVLEPRKSDFFINKRVRDVGCGLRHTVFVLDDGTVYTCGCNDLGQLGHEKSRKKPEILKVCQISRLYRLLVVTIIHLHFLKQVKSSVGDRINMANWV

SEQ ID NO: 6890 - protein, 1057 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 6891 - protein, 359 aa, Homo sapiens; identical to SEQ ID NO: 4870

SEQ ID NO: 6892 - protein, 237 aa, Homo sapiens
MEVMEGPLNLAHQQSRRADRLLAAGKYEEAISCHKKAAAYLSEAMKLTQSEQAHLSLELQRDSHMKQLLLIQERWKRAQREERLKAQQNTVLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 6893 - protein, 485 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 6894 - protein, 483 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALLQQTASSGNLNTLSSLHPMGGLNAMQLQNLAALAAAASAAQNTPSGTNALTTSSSPLSVLTSSAGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 6895 - protein, 1189 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYKSTKEDRRSEEKAAAMAASKKTAPPGSAVGKQPAPRNLVPKKSSFANVAAATPAIKKPPSGFKGTIPKRPWLSATPSSGASAARQAGPAPAAATAASKKFPGSAALVGAVRKPVVPSVPMASPAPGRLGAMSAAPSQPNSQIRQNIRRSLKEILWKRVNDSDDLIMTENEVGKIALHIEKEMFNLFQVTDNRYKSKYRSIMFNLKDPKNQGLFHRVLREEISLAKLVRLKPEELVSKELSTWKERPARSVMESRTKLHNESKKTAPRQEAIPDLEDSPPVSDSEEQQESARAVPEKSTAPLLDVFSSMLKDTTSQHRAHLFDLNCKICTGQVPSAEDEPAPKKQKLSASVKKEDLKSKHDSSAPDPAPDSADEVMPEAVPEVASEPGLESASHPNVDRTYFPGPPGDGHPEPSPLEDLSPCPASCGSGVVTTVTVSGRDPRTAPSSSCTAVASAASRPDSTHMVEARQDVPKPVLTSVMVPKSILAKPSSSPDPRYLSVPPSPNISTSESRSPPEGDTTLFLSRLSTIWKGFINMQSVAKFVTKAYPVSGCFDYLSEDLPDTIHIGGRIAPKTVWDYVGKLKSSVSKELCLIRFHPATEEEEVAYISLYSYFSSRGRFGVVANNNRHVKDLYLIPLSAQDPVPSKLLPFEGPGKRRLSGWR

SEQ ID NO: 6896 - protein, 1189 aa, Homo sapiens; identical to SEQ ID NO: 6895

SEQ ID NO: 6897 - protein, 2240 aa, Homo sapiens; identical to SEQ ID NO: 4982

SEQ ID NO: 6898 - protein, 295 aa, Homo sapiens; identical to SEQ ID NO: 5678

SEQ ID NO: 6899 - protein, 277 aa, Homo sapiens; identical to SEQ ID NO: 6399

SEQ ID NO: 6900 - protein, 414 aa, Homo sapiens
MGTVTEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTSYSTGF

SEQ ID NO: 6901 - protein, 842 aa, Homo sapiens
MSSSHFASRHRKDISTEMIRTKIAHRKSLSQKENRHKEYERNRHFGLKDVNIPTLEGRILVELDETSQGLVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSVGSCYVARAGLEVLGSSDPTTSASRVAGTTARSKLQ

SEQ ID NO: 6902 - protein, 569 aa, Homo sapiens
MLCSPSFCKLCWKRQRENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 6903 - protein, 587 aa, Homo sapiens
MSTAIPGLKKGNNALQSIILQTLLEKENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 6904 - protein, 539 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 6905 - protein, 347 aa, Homo sapiens
FSLFPAVDNEEAALLHEEATMTIEELLTRYGQNCHKGPPHSKSGASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 6906 - protein, 405 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLPCSWPLPCLLSPSTV

SEQ ID NO: 6907 - protein, 674 aa, Homo sapiens; identical to SEQ ID NO: 5910

SEQ ID NO: 6908 - protein, 879 aa, Homo sapiens
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDGSGINYSAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 6909 - protein, 771 aa, Homo sapiens
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSAYFRLQESFFNLPQLLFPENVMQNKDNALVELDHRIDFELREGLVESRYWSAVTSHTAYWSSLDVALFLLTFMYKHEHDDDAKPNLDPI

SEQ ID NO: 6910 - protein, 392 aa, Homo sapiens
MGTTCLHLGTLEQSLVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPYDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 6911 - protein, 206 aa, Homo sapiens
MSSPRDFRAEPVNDYEGNDSEAEDLNFRETLPSSSQENTPRSKVFENKVNSEKVKLSLRNFPHNDYEDVFEEPSESGSDPSMWTARGPFRRDRWSSEDEEAAGPSQALSPLLSDTRKIVSEGELDQLAQIRPLIFNFHEQTAIKDCLKILEEKTAAYDIMQEFMFNIMDIVAQMREQRSGMVQTKEQYHFCYDIVLEVLRKLLTLD

SEQ ID NO: 6912 - protein, 145 aa, Homo sapiens
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERTTFWHGSNEGAVSLLLRYCA

SEQ ID NO: 6913 - protein, 339 aa, Homo sapiens; identical to SEQ ID NO: 5550

SEQ ID NO: 6914 - protein, 348 aa, Homo sapiens
MQFGELLAAVRKAQANVMLFLEEKEQAALSQANGIKAHLEYRSAEMEKSKQELETMAAISNTVQFLEEYCKFKNTEDITFPSVYIGLKDKLSGIRKVITESTVHLIQLLENYKKKLQEFSKEEEYDIRTQVSAIVQRKYWTSKPEPSTREQFLQYVHDITFDPDTAHKYLRLQEENRKVTNTTPWEHPYPDLPSRFLHWRQVLSQQSLYLHRYYFEVEIFGAGTYVGLTCKGIDQKGEERSSCISGNNFSWSLQWNGKEFTAWYSDMETPLKAGPFWRLGVYIDFPGGILSFYGVEYDSMTLVHKFACKFSEPVYAAFWLSKKENAIRIVDLGEEPEKPAPSLVGTAP

SEQ ID NO: 6915 - protein, 348 aa, Homo sapiens; identical to SEQ ID NO: 6914

SEQ ID NO: 6916 - protein, 228 aa, Homo sapiens
MIDDSTRVPLGKSKDYINASYIRIVNCGEEYFYIATQGPLLSTIDDFWQMVLENNSNVIAMITREIEGGIIKCYHYWPISLKKPLELKHFRVFLENYQILQYFIIRMFQVVEKSTGTSHSVKQLQFTKWPDHGTPASADSFIKYIRYARKSHLTGPMVVHCSAGIGRTGVFLCVDVVFCAIVKNCSFNIMDIVAQMREQRSGMVQTKEQYHFCYDIVLEVLRKLLTLD

SEQ ID NO: 6917 - protein, 482 aa, Homo sapiens; identical to SEQ ID NO: 5986

SEQ ID NO: 6918 - protein, 339 aa, Homo sapiens; identical to SEQ ID NO: 5550

SEQ ID NO: 6919 - protein, 206 aa, Homo sapiens; identical to SEQ ID NO: 6911

SEQ ID NO: 6920 - protein, 145 aa, Homo sapiens; identical to SEQ ID NO: 6912

SEQ ID NO: 6921 - protein, 228 aa, Homo sapiens; identical to SEQ ID NO: 6916

SEQ ID NO: 6922 - protein, 933 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESRQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 6923 - protein, 932 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILTTIGVLEEPLGNARLHGARLMAALLHTNTPSINQELCRLNTMDLLLDLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGKTDAPPEGAALNGPV

SEQ ID NO: 6924 - protein, 262 aa, Homo sapiens; identical to SEQ ID NO: 5940

SEQ ID NO: 6925 - protein, 905 aa, Homo sapiens
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRANCFIMRNSLLLIKQQGGVILLR

SEQ ID NO: 6926 - protein, 368 aa, Homo sapiens; identical to SEQ ID NO: 6275

SEQ ID NO: 6927 - protein, 368 aa, Homo sapiens; identical to SEQ ID NO: 6275

SEQ ID NO: 6928 - protein, 914 aa, Homo sapiens
MSSSGYPPNQGAFSTEQSRYPPHSVQYTFPNTRHQQDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEGR

SEQ ID NO: 6929 - protein, 2343 aa, Homo sapiens
MSSSGYPPNQGAFSTEQSRYPPHSVQYTFPNTRHQQDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVSSNKSTNHERKSTLTPTQRESIPAKSPVPGVDPVVSHSPFDPHHRGSTAGEVYRSHLPTHLDPAMPFHRALDPAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 6930 - protein, 2337 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKEISSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 6931 - protein, 1024 aa, Homo sapiens
MPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 6932 - protein, 1606 aa, Homo sapiens
MLLHLCSVKNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 6933 - protein, 402 aa, Homo sapiens
MAALCRTAESQAELQCTQLDLERKLKLNENAISRLQANQKSVLVSVSEVKAVAEMQFGELLAAVRKAQANVMLFLEEKEQAALSQANGIKAHLEYRSAEMEKSKQELETMAAISNTVQFLEEYCKFKNTEDITFPSVYIGLKDKLSGIRKVITESTVHLIQLLENYKKKLQEFSKEEEYDIRTQVSAIVQRKYWTSKPEPSTREQFLQYVHDITFDPDTAHKYLRLQEENRKVTNTTPWEHPYPDLPSRFLHWRQVLSQQSLYLHRYYFEVEIFGAGTYVGLTCKGIDQKGEERSSCISGNNFSWSLQWNGKEFTAWYSDMETPLKAGPFWRLGVYIDFPGGILSFYGVEYDSMTLVHKFACKFSEPVYAAFWLSKKENAIRIVDLGEEPEKPAPSLVGTAP

SEQ ID NO: 6934 - protein, 558 aa, Homo sapiens
MHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 6935 - protein, 1196 aa, Homo sapiens
VPPCPAELRSVTNGQSNQPSNEGDAIKVFVRIRPPAERSGSADGEQNLCLSVLSSTSLRLHSNPEPKTFTFDHVADVDTTQESVFATVAKSIVESCMSGYNGTIFAYGQTGSGKTFTMMGPSESDNFSHNLRGVIPRSFEYLFSLIDREKEKAGAGKSFLCKCSFIEIYNEQIYDLLDSASAGLYLREHIKKGVFVVGAVEQVVTSAAEAYQVLSGGWRNRRVASTSMNRESSRSHAVFTITIESMEKSNEIVNIRTSLLNLVDLAGSERQKDTHAEGMRLKEAGNINRSLSCLGQVITALVDVGNGKQRHVCYRDSKLTFLLRDSLGGNAKTAIIANVHPGSRCFGETLSTLNFAQRAKLIKNKAVVNEDTQGNVSQLQAEVKRLKEQLAELASGQTPPESFLTRDKKKTNYMEYFQEAMLFFKKSEQEKKSLIEKVTQLEDLTLKKEKFIQSNKMIVKFREDQIIRLEKLHKESRGGFLPEEQDRLLSELRNEIQTLREQIEHHPRVAKYAMENHSLREENRRLRLLEPVKRAQEMDAQTIAKLEKAFSEISGMEKSDKNQQGFSPKAQKEPCLFANTEKLKAQLLQIQTELNNSKQEYEEFKELTRKRQLELESELQSLQKANLNLENLLEATKACKRQEVSQLNKIHAETLKIITTPTKAYQLHSRPVPKLSPEMGSFGSLYTQNSSILDNDILNEPVPPEMNEQAFEAISEELRTVQEQMSALQAKLDEEEHKNLKLQQHVDKLEHHSTQMQELFSSERIDWTKQQEELLSQLNVLEKQLQETQTKNDFLKSEVHDLRVVLHSADKELSSVKLEYSSFKTNQEKEFNKLSERHMHVQLQLDNLRLENEKLLESKACLQDSYDNLQEIMKFEIDQLSRNLQNFKKENETLKSDLNNLMELLEAEKERNNKLSLQFEEDKENSSKEILKVLEAVRQEKQKETAKCEQQMAKVQKLEESLLATEKVISSLEKSRDSDKKVVADLMNQIQELRTSVCEKTETIDTLKQELKDINCKYNSALVDREESRVLIKKQEVDILDLKETLRLRILSEDIERDMLCEDLAHATEQLNMLTEASKKHSGLLQSAQRTDQEGSPDSGTSAQAKPKERGSRTEEEYNFKMRQLEHVMDSAAEDPQSPKTPPHFQTHLAKLLETQEQEIEDGRASKTSLEHLVTKLNEDREVKNAEILRMKEQLR

SEQ ID NO: 6936 - protein, 1087 aa, Homo sapiens
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 6937 - protein, 215 aa, Homo sapiens [sequence omitted]

SEQ ID NO: 6938 - protein, 991 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSINRIVNESHLDKEHDAVEVADCVKEKGQLTGKHCVSVIPDKPSLNKSNVLLQGASTQASSMSMPVLASFSKVDIPIRTGHPTVLESNSDFKVIPTFVTENNVIKSLTGSYAKLPSPEPSMSPKMHRRRSRTSSACHILINNPINACELSPKGKEQAMDLIIQDTDENTNVPEIMPKLPTDLAGVCSSKVYVGKNTSEVKEDVVLGKSNQVCQSSGNHLENKVTHGLVTVEGQLTSDERGAHIMNSTCAAMPKLHEPYASSQCIASPNFGTVSGLKPASMLEKNCSLQTELNKSYDVKNPSPLLMQNQNTRQQMDTPMVSCGNEQFLDNSFEKVKRRLDLDIDGLQKENCPYVITSGITEQERQHLPEKRYPKGSGFVNKNKMLGTSSKESEELLKSKMLAFEEMRKRLEEQHAQQLSLLIAEQEREQERLQKEIEEQEKMLKEKKAMTAEASELDINNAVELEWRKISDSSLLETMLSQADSLHTSNSNSSGFTNSAMQYSFVSANEAPFYLWGSSTSGLTKLSVTRPFGRAKTRWSQVFSLEIQAKFNKITAVAKGFLTRRLMQTDKLKQLRQTVKDTMEFIRSFQSEAPLKRGIVSAQDASLQERVLAQLRAALYGIHDIFFVMDAAERMSILHHDREVRKEKMLRQMDKMKSPRVALSAATQKSLDRKKYMKAAEMGMPNKKFLVKQNPSETRVLQPNQGQNAPVHRLLSRQGSICRKNPKKAAKCCDNLRRQHSLG

SEQ ID NO: 6939 - protein, 991 aa, Homo sapiens; identical to SEQ ID NO: 6938

SEQ ID NO: 6940 - protein, 332 aa, Homo sapiens; identical to SEQ ID NO: 5059

SEQ ID NO: 6941 - protein, 295 aa, Homo sapiens; identical to SEQ ID NO: 4972

SEQ ID NO: 6942 - protein, 455 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALNNAYGKTLRQHHGWVVRGVFAV

SEQ ID NO: 6943 - protein, 439 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALSVGMWV

SEQ ID NO: 6944 - protein, 327 aa, Homo sapiens; identical to SEQ ID NO: 5293

SEQ ID NO: 6945 - protein, 1742 aa, Homo sapiens
MMEGNGTENSCSRTRGWLQQDNDAKPWLWKFSNCFSRPEQTLPHSPQTKEYMENKKVAVELKDVPSPLHAGSKLFPAVPLPDIRSLQQPKIQLSSVPKVSCCAHCPNEPSTSPMRFGGGGGGSGGTSSLIHPGALLDSQSTRTITCQVGSGFAFQSASSLQNASARNNLAGIASDFPSMCLESNLSSCKHLPCCGKLHFQSCHGNVHKLHQFPSLQGCTSAGYFPCSDFTSGAPGHLEEHISQSELTPHLCTNSLHLNVVPPVCLKGSLYCEDCLNKPARNSIIDAAKVWPNIPPPNTQPAPLAVPLCNGCGTKGTGKETTLLLATSLGKAASKFGSPEVAVAGQVLENLPPIGVFWDIENCSVPSGRSATAVVQRIREKFFKGHREAEFICVCDISKENKEVIQELNNCQVTVAHINATAKNAADDKLRQSLRRFANTHTAPATVVLVSTDVNFALELSDLRHRHGFHIILVHKNQASEALLHHANELIRFEEFISDLPPRLPLKMPQCHTLLYVYNLPANKDGKSVSNRLRRLSDNCGGKVLSITGCSAILRFINQDSAERAQKRMENEDVFGNRIIVSFTPKNRELCETKSSNAIADKVKSPKKLKNPKLCLIKDASEQSSSAKATPGKGSQANSGSATKNTNVKSLQELCRMESKTGHRNSEHQQGHLRLVVPTHGNSSAAVSTPKNSGVAEPVYKTSQKKENLSARSVTSSPVEKKDKEETVFQVSYPSAFSKLVASRQVSPLLASQSWSSRSMSPNLLNRASPLAFNIANSSSEADCPDPFANGADVQVSNIDYRLSRKELQQLLQEAFARHGKVKSVELSPHTDYQLKAVVQMENLQDAIGAVNSLHRYKIGSKKILVSLATGAASKSLSLLSAETMSVLQDAPACCLPLFKFTDIYEKKFGHKLNVSDLYKLTDTVAIREQGNGRLVCLLPSSQARQSPLGSSQSHDGSSTNCSPIIFEELEYHEPVCRQHCSNKDFSEHEFDPDSYKIPFVILSLKTFAPQVHSLLQTHEGTVPLLSFPDCYIAEFGDLEVVQENQGGVPLEHFITCVPGVNIATAQNGIKVVKWIHNKPPPPNTDPWLLRSKSPVGNPQLIQFSREVIDLLKSQPSCVIPISHFIPSYHHHFAKQCRVSDYGYSKLIELLEAVPHVLQILGMGSKRLLTLTHRAQVKRFTQDLLKLLKSQASKQVIVREFSQAYHWCFSKDWDVTEYGVCELIDIVSEIPDTTICLSQQDNEMVICIPKRERTQDEIERTKQFSKDVVDLLRHQPHFRMPFNKFIPSYHHHFGRQCKLAYYGFTKLLELFEAIPDTLQVLECGEEKILTLTEVERFKALAAQFVKLLRSQKDNCLMMTDLLTEYAKTFGYTFRLQDYDVSSISALTQKLCHVVKVADIESGRQIQLINRKSLRSLTAQLLVLLMSWEGTTHLSVEELKRHYESTHNTPLNPCEYGFMTLTELLKSLPYLVEVFTNDKMEECVKLTSLYLFAKNVRSLLHTYHYQQIFLHEFSMAYTKYVGETLQPKTYGHSSVEELLGAIPQVVWIKGHGHKRIVVLKNDMKSRLSSLSLSPANHENQPSEGERILEVPESHTASELKLGADGSGPSHTEQELLRLTDDSPVDLLCAPVPSCLPSPQLRPDPVILQSADLIQFEERPQEPSEIMILNQEEKMEIPIPGKSKTLTSDSSSSCISAAVPVPPCPSSETSESLLSKDPVESPAKKQPKNRVKLAANFSLAPITKL

SEQ ID NO: 6946 - protein, 276 aa, Homo sapiens
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKEKEWEESAKTKIKMALLWRSSGGGPRVLSIPEAFMKNSFTLTPPGFSEHN

SEQ ID NO: 6947 - protein, 183 aa, Homo sapiens; identical to SEQ ID NO: 5664

SEQ ID NO: 6948 - protein, 319 aa, Homo sapiens
MLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 6949 - protein, 187 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGRNFS

SEQ ID NO: 6950 - protein, 89 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQTL

SEQ ID NO: 6951 - protein, 89 aa, Homo sapiens; identical to SEQ ID NO: 6950

SEQ ID NO: 6952 - protein, 490 aa, Homo sapiens
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLLSKNLSREINDCIGGTVLNISKSGSCSAIRIGHVGMQIEHIIENIVAVTKGLSEKLPEKWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKKPKIKEEAVKEKSPSLGKKDARQTPKKPEAKFFTTPSKSVRKASHTPKKWPKKPKVPQST

SEQ ID NO: 6953 - protein, 164 aa, Homo sapiens
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQAISSRL

SEQ ID NO: 6954 - protein, 835 aa, Homo sapiens
MTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTSIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPNMVKEFSAQIIAWRP

SEQ ID NO: 6955 - protein, 539 aa, Homo sapiens; identical to SEQ ID NO: 5502

SEQ ID NO: 6956 - protein, 147 aa, Homo sapiens; identical to SEQ ID NO: 5321

SEQ ID NO: 6957 - protein, 316 aa, Homo sapiens; identical to SEQ ID NO: 5850

SEQ ID NO: 6958 - protein, 316 aa, Homo sapiens; identical to SEQ ID NO: 5850

SEQ ID NO: 6959 - protein, 269 aa, Homo sapiens; identical to SEQ ID NO: 4783

SEQ ID NO: 6960 - protein, 390 aa, Homo sapiens; identical to SEQ ID NO: 5166

SEQ ID NO: 6961 - protein, 126 aa, Homo sapiens; identical to SEQ ID NO: 4701

SEQ ID NO: 6962 - protein, 236 aa, Homo sapiens
MQVQDDGVNLIPFAKCSRVVSRSPPPRLPSQSLRPMPQRYGDVFWKNLNQRPTPTWLEEQHIPPMLRATGCSQLGLYPPEQLPPPEMLWRRKKRRPCLEGMQQQGLGGVPARVRAVTYHLEDLRRRQSIINELKKAQWGSSGAASEPVVLGEEGCGFPSTNEYPDLEEERATYPQEEDRFLTPGRAQLLWSPWSPLDQEEACASRQLHSLASFSTVTARRNPLHNPWGMELAASEE

SEQ ID NO: 6963 - protein, 559 aa, Homo sapiens
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 6964 - protein, 393 aa, Homo sapiens
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSMEQVLFPKPGPLEPTQRLLSQLERGILVASNPRGLFVQRLCPIPISWNAPQAPPGPGPHLLPSNECVELFRTAYFCRDLVRYFQGLGPPPKFQVTLNFWEESHGSSHTPQNLITVKMEQAFARYLLEQTPEQQAAILSLV

SEQ ID NO: 6965 - protein, 817 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSKGFPLDKAVAYSKLRNPFLINDLAMQYYIQDRREVYRILQEEGIDLPRYAVLNRDPARPEECNLIEGEDQVEVNGAVFPKPFVEKPVSAEDHNVYIYYPSSAGGGSQRLFRKIGSRSSVYSPESSVRKTGSYIYEEFMPTDGTDVKVYTVGPDYAHAEARKSPALDGKVERDSEGKEIQYPVMLTAMEKLVARKVCVAFKQTVCGFDLLRANGHSFVCDVNGFSFVKNSMKYYDDCAKILGNTIMRELAPQFQIPWSIPTEAEDIPIVPTTSGTMMELRCVIAIIRHGDRTPKQKMKMEVKHPRFFALFEKHGGYKTGKLKLKRPEQLQEVLDITRLLLAELEKEPGGEIEEKTGKLEQLKSVLEMYGHFSGINRKVQLTYYPHGVKASNEGQDPQRETLAPSLLLVLKWGGELTPAGRVQAEELGRAFRCMYPGGQGDYAGFPGCGLLRLHSTFRHDLKIYASDEGRVQMTAAAFAKGLLALEGELTPILVQMVKSANMNGLLDSDGDSLSSCQHRVKARLHHILQQDAPFGPEDYDQLAPTRSTSLLNSMTIIQNPVKVCDQVFALIENLTHQIRERMQDPRSVDLQLYHSETLELMLQRWSKLERDFRQKSGRYDISKIPDIYDCVKYDVQHNGSLGLQGTAELLRLSKALADVVIPQEYGISREEKLEIAVGFCLPLLRKILLDLQRTHEDESVNKLHPL

SEQ ID NO: 6966 - protein, 138 aa, Homo sapiens; identical to SEQ ID NO: 4807

SEQ ID NO: 6967 - protein, 1433 aa, Homo sapiens; identical to SEQ ID NO: 5248

SEQ ID NO: 6968 - protein, 144 aa, Homo sapiens
MAEVQVLVLDGRGHLLGRLAAIVAKQVLLGRKVVVVRCEGINISGNFYRNKLKYLAFLRKRMNTNPSRGPYHFRAPSRIFWRTVRGMLPHKTKRGQAALDRLKVFDGIPPPYGNRPRRTWRRKLTNTQRSSRPTDSWSEPNKDC

SEQ ID NO: 6969 - protein, 135 aa, Homo sapiens [sequence omitted]

SEQ ID NO: 6970 - protein, 135 aa, Homo sapiens [sequence omitted]

SEQ ID NO: 6971 - protein, 227 aa, Homo sapiens
MEPQGYPAFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPK

SEQ ID NO: 6972 - protein, 517 aa, Homo sapiens
MTRLGTVPRKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRSPRGATGRKERFACSYGTDSSLADMFFVRLVNKLFWTKL

SEQ ID NO: 6973 - protein, 305 aa, Homo sapiens; identical to SEQ ID NO: 5213

SEQ ID NO: 6974 - protein, 308 aa, Homo sapiens
MIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 6975 - protein, 513 aa, Homo sapiens [sequence omitted]

SEQ ID NO: 6976 - protein, 711 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 6977 - protein, 1116 aa, Homo sapiens; identical to SEQ ID NO: 6025

SEQ ID NO: 6978 - protein, 410 aa, Homo sapiens
MQNIHGKEIDLLRTTVKVPGKRLPRATPATAPGTSPRANGLSVERSNTQLGGGTASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 6979 - protein, 163 aa, Homo sapiens
MSDSPAGSNPRTPESSGSGSGGGGKRPAVPAAVSLLPPADPLRQANRLPIRVLKMLSAHTGHLLHPEYLQPLSSTPVSPIELDAKKSPLALLAQTCSQIGSPGSLSLRNPHTLGLSRYHPYGKSHLSTAGGLAVPSLPTAGPYYSPYALYGQRLASASALGYQ

SEQ ID NO: 6980 - protein, 911 aa, Homo sapiens
MNFQAGGGQSPQQQQSLAAPGGGGAAAQQLVCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 6981 - protein, 352 aa, Homo sapiens; identical to SEQ ID NO: 6708

SEQ ID NO: 6982 - protein, 168 aa, Homo sapiens
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNF

SEQ ID NO: 6983 - protein, 330 aa, Homo sapiens
MERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 6984 - protein, 297 aa, Homo sapiens
MKTLSPDRIQPHIMTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 6985 - protein, 357 aa, Homo sapiens
MVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 6986 - protein, 128 aa, Homo sapiens
MVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGFGKILDVEIIFNERGS

SEQ ID NO: 6987 - protein, 356 aa, Homo sapiens
MQGILLLVFAKYQHLPYIQILSTKSTPTGLFGYWGNKGGVNICLKLYGYYVSIINCHLPPHISNNYQRLEHFDRILEMQNCEGRDIPNILDHDLIIWFGDMNFRIEDFGLHFVRESIKNRCYGGLWEKDQLSIAKKHDPLLREFQEGRLLFPPTYKFDRNSNDYDTSEKKRKPAWTDRILWRLKRQPCAGPDTPIPPASHFSLSLRGYSSHMTYGISDHKPVSGTFDLELKPLVSAPLIVLMPEDLWTVENDMMVSYSSTSDFPSSPWDWIGLYKVGLRDVNDYVSYAWVGDSKVSCSDNLNQVYIDISNIPTTEDEFLLCYYSNSLRSVVGISRPFQIPPGSLREDPLGEAQPQI

SEQ ID NO: 6988 - protein, 583 aa, Homo sapiens; identical to SEQ ID NO: 5936

SEQ ID NO: 6989 - protein, 442 aa, Homo sapiens
MANSFAARIFTTLSDLQTNMANLKVIGIVIGKTDVKGFPDRKNIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPDIPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCTFVLSHRARSGLKISVLSCKLADPTEASRNLSGQKHV

SEQ ID NO: 6990 - protein, 208 aa, Homo sapiens
MAGTARHDREMAIQAKKKLTTATDPIERLRLQCLARGSAGIKGLGRVFRIMDDDNNRTLDFKEFMKGLNDYAVVMEKEEVEELFRRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSASIDTDVYFIIMMRTAWKL

SEQ ID NO: 6991 - protein, 208 aa, Homo sapiens; identical to SEQ ID NO: 6990

SEQ ID NO: 6992 - protein, 262 aa, Homo sapiens
HSYSEGLGHPRVSQALVTFHQQKPIEPRRELLTQPCRQKDPANVDYEDLFLYSNAVAEEAACPVSAPEEASPKPVLCHQSKERKPSAEMNRITTKEATSSCPPKSPLGETRQKLWRSLKMLPERGQRVRQQKSHLATVNLSSLLDVRRSTVISGPGTGKGSQDHSGDPTSGDRGYTDPCVATSLKSPSQPQAPKDRKVPTRKAERSVSCIEVTPGDRSWHQMVVRALSSQESKPEHQGLAEPENDQLPEEYQQPPPFAPGYC

SEQ ID NO: 6993 - protein, 646 aa, Homo sapiens
MSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIHQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 6994 - protein, 466 aa, Homo sapiens
MRGPNSGTEKGRLVIPEKQGFDFLCMPVFHPRFKREFIQEPAKNRPGPQTRSDLLLSGRDWNTLIVGKLSPWIRPDSKVEKIRRNSEALEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 6995 - protein, 620 aa, Homo sapiens
MRGPNSGTEKGRLVIPEKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 6996 - protein, 756 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDESLLGVLYPLWAPPPVPAPVGAPTVHPFLARWFSHVPWEPAGSADPRASSTPAGGTTWATGLLGDFDACGSQSRECVKGVWWTLLGFRCPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQALLPVALLRHRVAHFSDANFVLGSYKTEQCPKPPRLCRQGYACPHYHNSRDRRRNPRRFQYRSTPCPSVKHGDEWGEPSRCDGGDGCQYCHSRTEQQFHPEGPVGSPVSGAFSVFSHAGLVADPSLWYPAEWSWHHVGHSRTINPEGDKPSRLGPAPENIKRGNDFACDGRADAAGMAPHVCVFPIYKSTKCNDMRQTGYCPRGPFCAFAHVEKSLGMVNEWGCHDLHLTSPSSTGSGQPGNAKRRDSPAEGGPRGSEQDSKQGVRAHGVYVFEQNHLAVFAAVHPPAPSVSSSVASSLASSAGSGSSSPTALPAPPARALPLGPASSTVEAVLALEPTPSSPTSSAVQGVAGELGMGSGGQGCWSHVVGALAAVPAWTHSGDLEWDPSTIRTRVNVGGGPAARPAMTLAREPQLLVVGGCPTRNCSGPAASPQQLLDDAGQGGRGERDSSQRPLRPQTTHRQDTRPVPS

SEQ ID NO: 6997 - protein, 182 aa, Homo sapiens
MTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 6998 - protein, 147 aa, Homo sapiens
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQIIGVSIKRNYKI

SEQ ID NO: 6999 - protein, 173 aa, Homo sapiens
MGTFDLWTDYLGLAHLVRALSGKEGPETRLSPQPEPEPMLEPDQKRSLESSPAPERLCSFCKHNGESRAIYQSHVLKDEAGRVLCPILRDYVCPQCGATRERAHTRRFCPLTGQGYTSVYSHTTRNSAGKKLVRPDKAKTQDTGHRRGGGGGAGFRGAGKSEPSPSCSPSMST

SEQ ID NO: 7000 - protein, 573 aa, Homo sapiens
MSAFCLGLVGRASAPAEPDSACCMELPAAAGDAVRSPAAAAALIFPGGSGELELALEEELALLAAGERPSDPGEHPQAEPGSLAEGAGPQPPPSQDPELLSVIRQKEKDLVLAARLGKALLERNQDMSRQYEQMHKELTDKLEHLEQEKHELRRRFENREGEWEGRVSELESDVKQLQDELERQQIHLREADREKSRAVQELSEQNQRLLDQLSRASEVERQLSMQVHALREDFREKNSSTNQHIIRLESLQAEIKMLSDRKRELEHRLSATLEENDLLQGTVEELQDRVLILERQGHDKDLQLHQSQLELQEVRLSCRQLQVKVEELTEERSLQSSAATSTSLLSEIEQSMEAEELEQEREQLRLQLWEAYCQVRYLCSHLRGNDSADSAVSTDSSMDESSETSSAKDVPAGSLRTALNELKRLIQSIVDGMEPTVTLLSVEMTALKEERDRLRVTSEDKEPKEQLQKAIRDRDEAIAKKNAVELELAKCRMDMMSLNSQLLDAIQQKLNLSQQLEAWQDDMHRVIDRQLMDTHLKERSQPAAALCRGHSAGRGDEPSIAEGKRLFSFFRKI

SEQ ID NO: 7001 - protein, 361 aa, Homo sapiens; identical to SEQ ID NO: 5755

SEQ ID NO: 7002 - protein, 1032 aa, Homo sapiens
MAFTNYSSLNRAQLTFEYLHTNSTTHEFLFGALAELVDNARDADATRIDIYAERREDLRGGFMLCFLDDGAGMDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 7003 - protein, 1980 aa, Homo sapiens; identical to SEQ ID NO: 5126

SEQ ID NO: 7004 - protein, 170 aa, Homo sapiens; identical to SEQ ID NO: 5770

SEQ ID NO: 7005 - protein, 96 aa, Homo sapiens
MCHTSCSPACQPTCCIHSPCQASCYVPVSCQSSVCMPVSCTRIVCVAPSCQPSVCVPVSCRPIIYVTPSCQSSGCCQPPCTTALCRPISCSTPSCC

SEQ ID NO: 7006 - protein, 292 aa, Homo sapiens
MAASTMSIRSSAYSDSWQVDDCPESCCEPPCCATSCCAPAPCLTLVCTPVSRVSSPCCQVTCEPSPCQSGCTSSCTPSCCQQSSCQPAYCTSSPCQQACCVPVCCKPVCCVPVCCGASSCCQQSSYQPACCASSSCQPACCVPVCCKPVCCAPTCSEDSYSCCQQSSCQPACCTSSPCQQSYCVPVCCKPVCCKPICCVPVCSGASSLCCQQSGCQPACCTTSCCRPSSSVSLLCRPVCRPACCVPVSSCCAPTSSRQPSYCRQASCVSLLCRPVCSRPACYSFSSGQKSSC

SEQ ID NO: 7007 - protein, 535 aa, Homo sapiens
MKKISLKTLRKSFNLNKSKEETDFMVVQQPSLASDFGKDDSLFGSCYGKDMASCDINGEDEKGGKNRSKSESLMGTLKRRLSAKQKSKGKAGTPSGSSADEDTFSSSSAPIVFKDVRAQRPIRSTSLRSHHYSPAPWPLRPTNSEETCIKMEVRVKALVHSSSPSPALNGVRKDFHDLQSETTCQEQANSLKSSASHNGDLHLHLDEHVPVVIGLMPQDYIQYTVPLDEGMYPLEGSRSYCLDSSSPMEVSAVPPQVGGRAFPEDESQVDQDLVVAPEIFVDQSVNGLLIGTTGVMLQSPRAGHDDVPPLSPLLPPMQNNQIQRNFSGLTGTEAHVAESMRCHLNFDPNSAPGVARVYDSVQSSGPMVVTSLTEELKKLAKQGWYWGPITRWEAEGKLANVPDGSFLVRDSSDDRYLLSLSFRSHGKTLHTRIEHSNGRFSFYEQPDVEGHTSIVDLIEHSIRDSENGAFCYSRSRLPGSATYPVRLTNPVSRFMQVRSLQYLCRFVIRQYTRIDLIQKLPLPNKMKDYLQEKHY

SEQ ID NO: 7008 - protein, 419 aa, Homo sapiens
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 7009 - protein, 320 aa, Homo sapiens; identical to SEQ ID NO: 5744

SEQ ID NO: 7010 - protein, 578 aa, Homo sapiens [sequence omitted]

SEQ ID NO: 7011 - protein, 874 aa, Homo sapiens
MNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRPFGSQPWHSCHKLIYVRPNPKTGVPIGHWPVPESFWPDQNSPTLPPRTSHPVVKFSCTDCEPMVIDKLPFDKYELEPSPLTQFILERKSPQTCWQVYVSNSAKYSELGHPFGYLKASTALNCVNLFVMPYNYPVLLPLLDDLFKVHKAKPTLKWRQSFESYLKTMPPYYLGPLKKAVRMMGAPNLIADSMEYGLSYSVISYLKKLSQQAKIESDRVIGSVGKKVVQETGIKVRSRSHGLSMAYRKDFQQLLQGISEDVPHRLLDLNMKEYTGFQVALLNKDLKPQTFRNAYDIPRRNLLDHLTRMRSNLLKSTRRFLKGQDEDQVHSVPIAQMGNYQEYLKQVPSPLRELDPDQPRRLHTFGNPFKLDKKGMMIDEADEFVAGPQNKHKRPGEPNMQGIPKRRRCMSPLLRGRQQNPVVNNHIGGKGPPAPTTQAQPDLIKPLPLHKISETTNDSIIHDVVENHVADQLSSDITPNAMDTEFSASSPASLLERPTNHMEALGHDHLGTNDLTVGGFLENHEEPRDKEQCAEENIPASSLNKGKKLMHCRSHEEVNTELKAQIMKEIRKPGRKYERIFTLLKHVQGSLQTRLIFLQNVIKEASRFKKRMLIEQLENFLDEIHRRANQINHINSN

SEQ ID NO: 7012 - protein, 779 aa, Homo sapiens
MADYSNKLYYQLEQETGIQTGYTRTGSIFLAQTQDRLISLKRINAGLNVIGIPSEIISPKKVAELHHLLNVHDLVGAMHVPEDAVVSSADVALALASAASQNGVQIYDRTSVLHVMVKKGQVTGVETDKGQIECQYFVNCAGQWAYELGLSNEEPVSIPLHACEHFYLLTRPLETPLQSSTPTIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITSTGDQALEVLQYLFSNDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 7013 - protein, 396 aa, Homo sapiens
MATRVEEAARGRGGGAEEATEAGRGGRRRSPRQKLEESRSVQKQMKILQKKQAQIVKEKVHLQSEHSKAILARSKLESLCRELQRHNKTLKEENMQQAREEEERRKEATAHFQITLNEIQAQLEQHDIHNAKLRQENIELGEKLKKLIEQYALREEHIDKVFKHKELQQQLVDAKLQQTTQLIKEADEKHQREREFLLKEATESRHKYEQMKQQEVQLKQQLSLYMDKFEEFQTTMAKSNELFTTFRQEMEKMTKKIKKLEKETIIWRTKWENNNKALLQMAEEKTVRDKEYKALQIKLERLEKLCRALQTERNELNEKVEVLKEQVSIKAAIKAANRDLATPVMQPCTALDSHKELNTSSKRALGAHLEAEPKSQRSAVQKPPSTGSAPAIESVD

SEQ ID NO: 7014 - protein, 480 aa, Homo sapiens; identical to SEQ ID NO: 6357

SEQ ID NO: 7015 - protein, 1257 aa, Homo sapiens
MAHFSSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKEYKEMMHYLKNIMIAVVESMINKFEEDETRNQERQKKIQKEKSHSYRTDNCSDSDSSLNQSYKFCQGKLQLILDQLDPGQPKEVRYEALQTLCSAPPSDVLNCENWTTLCEKLTVSLSDPDPVFSDRILKFCAQTFLLSPLHMTKEIYTSLAKYLESYFLSRENHIPTLSAGVDITNPNMTRLLKKVRLLNEYQKEAPSFWIRHPEKYMEEIVESTLSLLTVKHNQSHVVSQKILDPIYFFALVDTKAVWFKKWMHAHYSRTTVLRLLETKYKSLVTTAIQQCVQYFEMCKTRKADETLGHSKHCRNKQKTFYYLGQELQYIYFIHSLCLLGRLLIYKQGRKLFPIKLKNKKGLVSLIDLLVLFTQLIYYSPSCPKMTSAAHSENYSPASMVTEVLWILSDQKECAVECLYNNIVIETLLQPIHNLMKGNEASPNCSETALIHIAGILARIASVEEGLILLLYGANMNSSEESPTGAHIIAQFSKKLLDEDISIFSGSEMLPVVKGAFISVCRHIYSTCEGLQVLITYNLHESIAKAWKKTSLLSERIPTPVEGSDSVSSVSQESQNIMAWEDNLLDDLLHFAATPKGLLLLQRTGAINECVTFIFNRYAKKLQVSRHKKFGYGVLVTRVASTAAGGIALKKSGFINELITELWSNLEYGRDDVRVTHPRTTPVDPIDRSCQKSFLALVNLLSYPAIYELVRNQDLPNKTEYSLREVPTCVIDIIDRLIILNSEAKIRSLFNYEQSHIFGLRDFIIDGLSVERNHVLVRINLVGGPLERILPPRLLEKSDNPYPWPMFSSYPLPNCYLSDITRNAGIKQDNDLDKLLLCLKISDKQTEWIENCQRQFCKMMKAKPDIISGEALIELLEKFVLHLTESPSECYFPSVEYTATDANVKNESLSSVQQLGIKMTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISSYLPNDTVESGIHPVYFCSTHYIEMLLKAELPLVFSAFHMSGFAPSQICLQWITQCFWNYLDWIEICHYIATCVFLGPDYQVYICIAVFKHLQQDILQHTQTQDLQVFLKEEALHGFRVSDYFEYMEILEQNYRTVLLRDMRNIRLQST

SEQ ID NO: 7016 - protein, 203 aa, Homo sapiens
MATPYVTDETGGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 7017 - protein, 242 aa, Homo sapiens; identical to SEQ ID NO: 6632

SEQ ID NO: 7018 - protein, 245 aa, Homo sapiens; identical to SEQ ID NO: 5192

SEQ ID NO: 7019 - protein, 339 aa, Homo sapiens
MMDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 7020 - protein, 255 aa, Homo sapiens; identical to SEQ ID NO: 5089

SEQ ID NO: 7021 - protein, 146 aa, Homo sapiens
MVNSCCGSVCSDQGCDQGLCQETCCRPSCCQTTCCCPSCVVSSCCRPSCSQTTCCQTTCCRPSCCHPVCCQTTCRPSCGVSSCCRPLCCQTTCHPSCGMSSCCRPLCCQTTCRPSCGVSSCCRPLCCQTTCCRATCCRPSCCGSSC

SEQ ID NO: 7022 - protein, 431 aa, Homo sapiens; identical to SEQ ID NO: 6528

SEQ ID NO: 7023 - protein, 156 aa, Homo sapiens
MGCCGCSGGCGSGCGGCGSGSGGCGSGCGGCGSSCCVPICCCKPVCCCVPACSCSSCGSCGGSKGGCGSCGSSKGGCGSCGCSQSNCCKPCCSSSGCGSFCCQSSCSKPCCCQSSCCQSSCCKPCCCQSSCCQSSCFKPCCCQSSCCVPVCCQCKI

SEQ ID NO: 7024 - protein, 202 aa, Homo sapiens
MGCCGCSGGCGSGCGGCGSGCGGCGSGCGGYGSGCGGCGSSCCVPVCCCKPVCCCVPACSCSSCGSCGGSKGDCGSCGGSKGGCGSCGGSKGGCGSCGGSKGGCGSCGGSKGGCGSCGGSKGGCGSCGGSKGGCGSCGCSQCNCCKPCCCSSGCGSCCQSSCCNPCCCQSSCCVPVCCQSSCCKPCCCQSSCCVPVCCQCKI

SEQ ID NO: 7025 - protein, 165 aa, Homo sapiens
MGCCGCSEGCGSGCGGCGSGCGGCGSGCGGCGSSCCVPVCCCKPVCCCVPACSCSSCGSCGGSKGGCGSCGGSKGGCGSCGGSKGGCGSCGCSQCSCYKPCCCSSGCGSSCCQSSCCKPCCCQSSCCKPCCCSSGCGSSCCQSSCCNPCCSQSSCCVPVCCQCKI

SEQ ID NO: 7026 - protein, 1034 aa, Homo sapiens
MASVFMCGVEDLLFSGSRFVWNLTVSTLRRWYTERLRACHQVLRTWCGLQDVYQMTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 7027 - protein, 166 aa, Homo sapiens
MLSQSCNLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 7028 - protein, 132 aa, Homo sapiens; identical to SEQ ID NO: 6620

SEQ ID NO: 7029 - protein, 124 aa, Homo sapiens; identical to SEQ ID NO: 5720

SEQ ID NO: 7030 - protein, 111 aa, Homo sapiens
LMDLDSGDVKRRVHLFETQRRTKEEDPIIPFSDGPIISKWGAISRSSRTGYHTTDPVQATASQGSATKPISVSGGVHMATRPHHQHTMLKGTDSLLLIYLVIESIPVLGTF

SEQ ID NO: 7031 - protein, 132 aa, Homo sapiens; identical to SEQ ID NO: 6620

SEQ ID NO: 7032 - protein, 124 aa, Homo sapiens; identical to SEQ ID NO: 5720

SEQ ID NO: 7033 - protein, 345 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 7034 - protein, 418 aa, Homo sapiens
MLPNTGRLAGCTVFITGASRGIGKAIALKAAKDGANIVIAAKTAQPHPKLLGTIYTAAEEIEAVGGKALPCIVDVRDEQQISAAVEKAIKKFGGIDILVNNASAISLTNTLDTPTKRLDLMMNVNTRGTYLASKACIPYLKKSKVAHILNISPPLNLNPVWFKQHCAYTIAKYGMSMYVLGMAEEFKGEIAVNALWPKTAIHTAAMDMLGGPGIESQCRKVDIIADAAYSIFQKPKSFTGNFVIDENILKEEGIENFDVYAIKPGHPLQPDFFLDEYPEAVSKKVESTGAVPEFKEEKLQLQPKPRSGAVEETFRIVKDSLSDDVVKATQAIYLFELSGEDGGTWFLDLKSKGGNVGYGEPSDQADVVMSMTTDDFVKMFSGKLKPTMAFMSGKLKIKGNMALAIKLEKLMNQMNARL

SEQ ID NO: 7035 - protein, 358 aa, Homo sapiens
MPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVLLDLALQGAGDAEAAVVLEAALATLLTVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 7036 - protein, 49 aa, Homo sapiens
MSSCVSSQPSSNRAAPQDELGGRGSSSSESQKPCEALRGLSSLSIHLGM

SEQ ID NO: 7037 - protein, 865 aa, Homo sapiens
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 7038 - protein, 598 aa, Homo sapiens; identical to SEQ ID NO: 5577

SEQ ID NO: 7039 - protein, 605 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVELFVLHSKTGDMSWLTGKGS

SEQ ID NO: 7040 - protein, 457 aa, Homo sapiens
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEETINMFERNIVDMVGLFIENVQSLMAQCRDLENHHHEKLLEISISTLEKIVEGDLDEDLPNDLRAGRFQKFNYVEASGTF

SEQ ID NO: 7041 - protein, 457 aa, Homo sapiens; identical to SEQ ID NO: 7040

SEQ ID NO: 7042 - protein, 523 aa, Homo sapiens; identical to SEQ ID NO: 5355

SEQ ID NO: 7043 - protein, 523 aa, Homo sapiens; identical to SEQ ID NO: 5355

SEQ ID NO: 7044 - protein, 613 aa, Homo sapiens; identical to SEQ ID NO: 5032

SEQ ID NO: 7045 - protein, 129 aa, Homo sapiens; identical to SEQ ID NO: 6440

SEQ ID NO: 7046 - protein, 129 aa, Homo sapiens; identical to SEQ ID NO: 6440

SEQ ID NO: 7047 - protein, 1375 aa, Homo sapiens
MVPGEENQLVPKEDVFWRCRQNIFDEMKKKFLQIENAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLEDSSAGEDSVHDRFIGPLPREGSGGSTSDYVSQSYSYSSILNKSETGYVGLVNQAMTCYLNSLLQTLFMTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAFIQPEILDGPNQYFCERCKKKCDARKGLRFLHFPYLLTLQLKRFDFDYTTMHRIKLNDRMTFPEELDMSTFIDVEDEKSPQTESCTDSGAENEGSCHSDQMSNDFSNDDGVDEGICLETNSGTEKISKSGLEKNSLIYELFSVMVHSGSAAGGHYYACIKSFSDEQWYSFNDQHVSRITQEDIKKTHGGSSGSRGYYSSAFASSTNAYMLIYRLKDPARNAKFLEVDEYPEHIKNLVQKERELEEQEKRQREIERNTCKIKLFCLHPTKQVMMENKLEVHKDKTLKEAVEMAYKMMDLEEVIPLDCCRLVKYDEFHDYLERSYEGEEDTPMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSKEELIPQLREQCGLELSIDRFRLRKKTWKNPGTVFLDYHIYEEDINISSNWEVFLEVLDGVEKMKSMSQLAVLSRRWKPSEMKLDPFQEVVLESSSVDELREKLSEISGIPLDDIEFAKGRGTFPCDISVLDIHQDLDWNPKVSTLNVWPLYICDDGAVIFYRDKTEELMELTDEQRNELMKKESSRLQKTGHRVTYSPRKEKALKIYLDGAPNKDLTQD

SEQ ID NO: 7048 - protein, 199 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDPH

SEQ ID NO: 7049 - protein, 323 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 7050 - protein, 1512 aa, Homo sapiens
MAAAAGNRASSSGFPGARATSPEAGGGGGALKASSAPAAAAGLLREAGSGGRERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 7051 - protein, 757 aa, Homo sapiens
ADGGDSQAFRCTSCGHAGTTPAPREALSPADAHVGRGFAEREPIPAQGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 7052 - protein, 603 aa, Homo sapiens
MGVIPEGPLWVSGSDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEVESRSVTQAGGQWHDLGSLQPPPPGFK

SEQ ID NO: 7053 - protein, 331 aa, Homo sapiens
MAEGGGPEPGEQERRSSGPRPPSARDLQLALAELYEDEVKCKSSKSNRPKATVFKSPRTPPQRFYSSEHEYSGLNIVRPSTGKIVNELFKEAREHGAVPLNEATRASGDDKSKSFTGGGYRLGSSFCKRSEYIYGENQLQDVQILLKLWSNGFSLDDGELRPYNEPTNAQFLESVKRGEIPLELQRLVHGGQVNLDMEDHQDQEYIKPRLRFKAFSGEGQKLGSLTPEIVSTPSSPEEEDKSILNAVVLIDDSVPTTKIQIRLADGSRLIQRFNSTHRILDVRNFIVQSRPEFAALDFILVTSFPNKELTDESLTLLEADILNTVLLQQLK

SEQ ID NO: 7054 - protein, 687 aa, Homo sapiens
MDGGALTDTSLTDSYFSTSFIGVNGFGSPVETKYPLMQRMTNSSSSPSLLNDSAKPYSAHDPLTSPASSLFNDFGALNISQRRKTPNPTASEFIPKGGSTSRLSNVSQSNMSAFSQVFSHPSMGSPATAGLAPGMSLSAGSSPLHSPKITPHTSPAPRRRSHTPNPASYMVPSSASTSVNNPVSQTPSSGQVIQKETVGGTTYFYTDTTPAPLTGMVFPNYHIYPPTAPHVAYMQPKANAPSFFMADELRQELINRHLITMAQIDQADMPAVPTEVDSYHSLFPLEPLPPPNRIQKSSNFGYITSCYKAVNSKDDLPYCLRRIHGFRLVNTKCMVLVDMWKKIQHSNIVTLREVFTTKAFAEPSLVFAYDFHAGGETMMSRHFNDPNADAYFTKRKWGQHEGPLPRQHAGLLPESLIWAYIVQLSSALRTIHTAGLACRVMDPTKILITGKTRLRVNCVGVFDVLTFDNSQNNNPLALMAQYQQADLISLGKVVLALACNSLAGIQRENLQKAMELVTINYSSDLKNLILYLLTDQNRMRSVNDIMPMIGARFYTQLDAAQMRNDVIEEDLAKEVQNGRLFRLLAKLGTINERPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 7055 - protein, 2316 aa, Homo sapiens
MDGVSSEANEENDNIERPVRRRHSSILKPPRSPLQDLRGGNERVQESNALRNKKNSRRVSFADTIKVFQTESHMKIVRKSEMEETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTFVYDTIQLTITFEESVVGFPFLDKRYRKIVDVNFQSLLDEDQAPPSSLLVHKLIFQYVEEKESWKKTCTTQHQLPKMLEEFSLVVHHCRLLGEEIEYLKRWGPNYNLMNIDINNNELRLLFSSSAAFAKFEITLFLSAYYPSVPLPSTIQNHVGNTSQDDIATILSKVPLENNYLKNVVKQIYQDLFQDCHFYH

SEQ ID NO: 7056 - protein, 237 aa, Homo sapiens
MGCCGCSGGCGSGCGGRGSGCGGCGSGCGGCGSGCGGCGSGCGGCGGCGSGCAGCGGCGSGCCVPVCCCKPMCCCVPACSCSSCGKGGCGSCGGSKRGCVSCGVSKGACGSCGGSKGGCGSCGGSKGGCGSCGGSKGGCGSCGGSKGGCGSYGCSQSSCCKPCCCSSGCGSSCCQSSCCKPYCCQSSCCKPYCCQSSCCKPCSCFSGCGSSCCQSSCYKPCCCQSSCCVPVCCQCKI

SEQ ID NO: 7057 - protein, 238 aa, Homo sapiens
MGCSGCSGGCGSSCGGCGSSCGGCGSGYGGCGSGCCVPVCCCKPVCCCVPACSCSSCGSCGGSKGVCGSCGGCKGGCGSCGGSKGGCGSSCCVPVCCSSSCGSCGGSKGVCGFRGGSKGGCGSCGCSQCSCYKPCCCSSGCGSSCCQSSCCKPSCSQSSCCKPCCSQSSCCKPCCCSSGCGSSCCQSSCCKPCCSQSSCCKPCCCSSGCGSSCCQSSCCKPCSSQSSCCVPICCQCKI

SEQ ID NO: 7058 - protein, 490 aa, Homo sapiens; identical to SEQ ID NO: 5369

SEQ ID NO: 7059 - protein, 1941 aa, Homo sapiens
LLTSVLMPSFGYFIRSPEKREPIALIRKSDVSRGNLEKEMAHLNHDLYSGDLNEQSQAQLSEGSITLQVEAVESTSQVDENDVTLTADKGKTEDTFFMSNKPQRYKDKLPDSGDSMLRISTIASAIAEASVNTDPSQLAAMIKALSNKTRDKTFQEDEKQKDYSHVRHFLPNDLEKSNGSNALDMEKYLKKTEVSRYESALENFSRASMSDTWDLSLPKEQTTQDIHPVDLSATSVSVRAPEENTAAIVYVENGESENQESFRTINSSNSVTNRENNSAVVDVKTCSIDNKLQDVGNDEKATSISTPSDSYSSVRNPRITSLCLLKDCEEIRDNRENQRQNECVSEISNSEKHVTFENHRIVSPKNSDLKNTSPEHGGRGSEDEQESFRPSTSPLSHSSPSEISGTSSSGCALESFGSAAQQQQPPCEQELSPLVCSPAGVSRLTYVSEPESSYPTTATDDALEDRKSDITSELSTTIIQGSPAALEERAMEKLREKVPFQNRGKGTLSSIIQNNSDTRKATETTSLSSKPEYVKPDFRWSKDPSSKSGNLLETSEVGWTSNPEELDPIRLALLGKSGLSCQVGSATSHPVSCQEPIDEDQRISPKDKSTAGREFSGQVSHQTTSENQCTPIPSSTVHSSVADMQNMPAAVHALLTQPSLSAAPFAQRYLGTLPSTGSTTLPQCHAGNATVCGFSGGLPYPAVAGEPVQNSVAVGICLGSNIGSGWMGTSSLCNPYSNTLNQNLLSTTKPFPVPSVGTNCGIEPWDSGVTSGLGSVRVPEELKLPHACCVGIASQTLLSVLNPTDRWLQVSIGVLSISVNGEKVDLSTYRCLVFKNKAIIRPHATEEIKVLFIPSSPGVFRCTFSVASWPCSTDAETIVQAEALASTVTLTAIAESPVIEVETEKKDVLDFGDLTYGGWKALPLKLINRTHATVPIRLIINANAVAWRCFTFSKESVRAPVEVAPCADVVTRLAGPSVVNHMMPASYDGQDPEFLMIWVLFHSPKKQISSSDILDSAEEFSAKVDIEVDSPNPTPVLRSVSLRARAGIARIHAPRDLQTMHFLAKVASSRKQHLPLKNAGNIEVYLDIKVPEQGSHFSVDPKNLLLKPGEEHEVIVSFTPKDPEACEERILKIFVQPFGPQYEVVLKGEVISSGSKPLSPGPCLDIPSILSNKQFLAWGGVPLGRTQLQKLALRNNSASTTQHLRLLIRGQDQDCFQLQNTFGSEQRLTSNCEIRIHPKEDIFISVLFAPTRLSCMLARLEIKQLGNRSQPGIKFTIPLSGYGGTSNLILEGVKKLSDSYMVTVNGLVPGKESKIVFSVRNTGSRAAFVKAVGFKDSQKKVLLDPKVLRIFPDKFVLKERTQENVTLIYNPSDRGINNKTATELSTVYLFGGDEISRQQYRRALLHKPEMIKQILPEHSVLQNINFVEAFQDELLVTEVYDLPQRPNDVQLFYGSMCKIILSVIGEFRDCISSREFLQPSSKASLESTSDLGASGKHGGNVSLDVLPVKGPQGSPLLSRAARPPLDQLASEEPWTVLPEHLILVAPSPCDMAKTGRFQIVNNSVRLLRFELCWPAHCLTVTPQHGCVAPESKLQILVSPNSSLSTKQSMFPWSGLIYIHCDDGQKKIVKVQIREDLTQVELLTRLTSKPFGILSPVSEPSVSHLVKPMTKPPSTKVEIRNKSITFPTTEPGETSESCLELENHGTTDVKWHLSSLAPPYVKGVDESGDVFRATYAAFRCSPISGLLESHGIQKVSITFLPRGRGDYAQFWDVECHPLKEPHMKHTLRFQLSGQSIEAENEPENACLSTDSLIKIDHLVKPRRQAVSEASARIPEQLDVTARGVYAPEDVYRFRPTSVGESRTLKVNLRNNSFITHSLKFLSPREPFYVKHSKYSLRAQHYINMPVQFKPKSAGKFEALLVIQTDEGKSIAIRLIGEALGKN

SEQ ID NO: 7060 - protein, 36 aa, Homo sapiens
MCYYGNYYGGYGYGGLGCGYGSCCGCGFRRLGCGYG

SEQ ID NO: 7061 - protein, 175 aa, Homo sapiens
MSYNCCSGNFSSRSCGDYLRYPASSRGFSYPSNLVYSTDLCSPSTCQLGSSLYRGCQEICWEPTSCQTSYVESSPCQTSCYRPRTSLLCSPCKTTYSGSLGFGSSSCRSLGYGSRSCYSVGCGSSGVRSLGYGSCGFPSLGYGSGFCRPTYLASRSCQSPCYRPAYGSTFCRSTC

SEQ ID NO: 7062 - protein, 107 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVL

SEQ ID NO: 7063 - protein, 822 aa, Homo sapiens
MGKKRTKGKTVPIDDSSETLEPVCRHIRKGLEQGNLKKALVNVEWNICQDCKTDNKVKDKAEEETEEKPSVWLCLKCGHQGCGRNSQEQHALKHYLTPRSEPHCLVLSLDNWSVWCYVCDNEVQYCSSNQLGQVVDYVRKQASITTPKPEKDNGNIELENKKLEKESKNEQEREKKENMAKENPPMNSPCQITVKGLSNLGNTCFFNAVMQNLSQTPVLRELLKEVKMSGTIVKIEPPDLALTEPLEINLEPPGPLTLAMSQFLNEMQETKKGVVTPKELFSQVCKKAVRFKGYQQQDSQELLRYLLDGMRAEEHQRVSKGILKAFGNSTEKLDEELKNKVKDYEKKKSMPSFVDRIFGGELTSMIMCDQCRTVSLVHESFLDLSLPVLDDQSGKKSVNDKNLKKTVEDEDQDSEEEKDNDSYIKERSDIPSGTSKHLQKKAKKQAKKQAKNQRRQQKIQGKVLHLNDICTIDHPEDSEYEAEMSLQGEVNIKSNHISQEGVMHKEYCVNQKDLNGQAKMIESVTDNQKSTEEVDMKNINMDNDLEVLTSSPTRNLNGAYLTEGSNGEVDISNGFKNLNLNAALHPDEINIEILNDSHTPGTKVYEVVNEDPETAFCTLANREVFNTDECSIQHCLYQFTRNEKLRDANKLLCEVCTRRQCNGPKANIKGERKHVYTNAKKQMLISLAPPVLTLHLKRFQQAGFNLRKVNKHIKFPEILDLAPFCTLKCKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 7064 - protein, 823 aa, Homo sapiens; identical to SEQ ID NO: 5605

SEQ ID NO: 7065 - protein, 388 aa, Homo sapiens
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQKFQWIYPTQKLNKMR

SEQ ID NO: 7066 - protein, 450 aa, Homo sapiens; identical to SEQ ID NO: 5432

SEQ ID NO: 7067 - protein, 1125 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSKPENTTSQPLSNQRVVEVAIPHVGKFMIESKEGGYDDEIMMTPNMQGIIMAIGKSRSVYDRCGPEAGFFKAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 7068 - protein, 535 aa, Homo sapiens
MDLRQACRTPSRDEAGVELLMTYFIQLGFVESRFFPPTRQMGLLFTWYDSLTGVPVSQQNLLLEKASVLFNTGALYTQIGTRCDRQTQAGLESAIDAFQRAAGVLNYLKDTFTHTPSYDMSPAMLSVLVKMMLAQAQESVFEKISLPGIRNEFFMLVKVAQEAAKVGEVYQQLHAAMSQAPVKENIPYSWASLACVKAHHYAALAHYFTAILLIDHQVKPGTDLDHQEKCLSQLYDHMPEGLTPLATLKNDQQRRQLGKSHLRRAMAHHEESVREASLCKKLRSIEVLQKVLCAAQERSRLTYAQHQEEDDLLNLIDAPSVVAKTEQEVDIILPQFSKLTVTDFFQKLGPLSVFSANKRWTPPRSIRFTAEEGDLGFTLRGNAPVQVHFLDPYCSASVAGAREGDYIVSIQLVDCKWLTLSEVMKLLKSFGEDEIEMKVVSLLDSTSSMHNKSATYSVGMQKTYSMICLAIDDDDKTDKTKKISKKLSFLSWGTNKNRQKSASTLCLPSVGAARPQVKKKLPSPFSLLNSDSSWY

SEQ ID NO: 7069 - protein, 983 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQIMHAFSVAPFDQNLSIDGKILSDDCATLGTLGVIPESVILLKADEPIADYAAMDDVMQVCMPEEGFKGTGLLGH

SEQ ID NO: 7070 - protein, 245 aa, Homo sapiens
MSVCSSDLSYGSRVCLPGSCDSCSDSWQVDDCPESCCEPPCCAPAPCLSLVCTPVSRVSSPCCRVTCEPSPCQSGCTSSCTPSCCQQSSCQPACCTSSPCQQACCVPVCCKTVCCKPVCCMPVCCGPSSSCCQQSSCQPACCISSPCQQSCCVPVCCKPICCVPVCSGASSLCCQQSSCQPACCTTSCCRPSSSVSLLCRPVCRPARRVPVPSCCVPTSSCQPSCGRLASCGSLLCRPTCSRLAC

SEQ ID NO: 7071 - protein, 365 aa, Homo sapiens
MAASTMSVCSSDLSYGSRVCLPGSCDSCSDSWQVDDCPESCCEPPCCAPAPCLSLVCTPVSRVSSPCCPVTCEPSPCQSGCTSSCTPSCCQQSSCQLACCASSPCQQACCVPVCCKTVCCKPVCCVSVCCGDSSCCQQSSCQSACCTSSPCQQACCVPVCCKPVCSGISSSCCQQSSCVSCVSSPCCQAVCEPSPCQSGCTSSCTPSCCQQSSCQPTCCTSSPCQQACCVPVCCVPVCCVPTCSEDSSSCCQQSSCQPACCTSSPCQHACCVPVCSGASTSCCQQSSCQPACCTASCCRPSSSVSLLCHPVCKSTCCVPVPSCGASASSCQPSCCRTASCVSLLCRPMCSRPACYSLCSGQKSSC

SEQ ID NO: 7072 - protein, 271 aa, Homo sapiens
MAACTMSVCSSACSDSWRVDDCPESCCEPPCGTAPCLTLVCTPVSCVSSPCCQAACEPSPCQSGCTSSCTPSCCQPACCASSPCQQACCVPVCCKPVCCLPTCSKDSSSCCQQSSCQPTCCASSSCQQSCCVPVCCKPVCCVPTCSEDSSSCCQHSSCQPTCCTSSPCQQSCYVPVCCKPVCFKPICCVPVCSGASTSCCQQSSCQPACCTTSCCRPSSSVSLLCRPICRPACCVPISSCCAPASSYQASCCRPASCVSLLCRPACSRLAC

SEQ ID NO: 7073 - protein, 401 aa, Homo sapiens
MSVCSSDLSYSSRVCLPGSCDSCSDSWQVDDCPESCCEPPCCAPSCCAPAPCLSLVCTPVSRVSSPCCPVTCEPSPCQSGCTSSCTPSCCQQSSCQLACCASSPCQQACCVPVCCKTVCCKPVCCVPVCCGDSSCCQQSSCQSACCTSSPCQQACCVPICCKPVCSGISSSCCQQSSCVSCVSSPCCQAVCEPSPCQSGCISSCTPSCCQQSSCQPACCTSSSCQQACCVPVCCKTVCCKPVCSEDSSSCCQQSSCQPACCTSSPCQQACCVPVCCKPVCCKPVGSVPICSGASSLCCQQSSCQPACCTSSQSQQGCCVPVCCKPVSCVPVCSGASSSCCQQSSCQPACCTTSCCRPSSSVSLLCRPVCRPACCVPVPSCCAPTSSCQPSCCRPASCVSLL

SEQ ID NO: 7074 - protein, 282 aa, Homo sapiens
MAASTMSVCSSACSDSWQVDACPESCCEPHCCALSCCAPAPCLTLVCTPVSRVSSPCCQAACEPSPCQSGCTSSCTPSCCQQSSCQPACCTSSPCQQACCVPVCCKPVCCLPTCSKDSSSCCQQSSCQPTCCASSSSQQSCCVPVCCKPVCYVPTCSEDSSSCCQQSSCHPACCTSSPCQQACCVPVRCKPVCCKPICCVPVCSGASTSCCQQSSCQPACCTTSCCRPSSSVSLLCRPVCRPACCMPVSSCCAPASSCQASCCRPASCVSLLCRPACSRPAC

SEQ ID NO: 7075 - protein, 296 aa, Homo sapiens
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSIRTRSIAFSSQTLMLLEEIFGEKDQEDYMRINEDNIWL

SEQ ID NO: 7076 - protein, 1781 aa, Homo sapiens
VKKIHRHRLSPATEKGAASSGEGDKDPPPPAHEDIAVKGTATAAGTGPGTGAAAAAAAAVPPPHPAAAAAAAAAAAAAAAAAVPPPHPNIRALQTQAPQQIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPVIFSPSQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 7077 - protein, 1585 aa, Homo sapiens; identical to SEQ ID NO: 4948

SEQ ID NO: 7078 - protein, 1028 aa, Homo sapiens
MASEAVKVVVRCRPMNQRERELRCQPVVTVDCARAQCCIQNPGAADEPPKQFTFDGAYHVDHVTEQIYNEIAYPLVEGVTEGYNGTIFAYGQTGSGKSFTMQGLPDPPSQRGIIPRAFEHVFESVQCAENTKFLVRASYLEIYNEDVRDLLGADTKQKLELKEHPEKGVYVKGLSMHTVHSVAQCEHIMETGWKNRSVGYTLMNKDSSRSHSIFTISIEMSAVDERGKDHLRAGKLNLVDLAGSERQSKTGATGERLKEATKINLSLSALGNVISALVDGRCKHVPYRDSKLTRLLQDSLGGNTKTLMVACLSPADNNYDETLSTLRYANRAKNIRNKPRINEDPKDALLREYQEEIKKLKAILTQQMSPSSLSALLSRQVPPDPVQVEEKLLPQPVIQHDVEAEKQLIREEYEERLARLKADYKAEQESRARLEEDITAMRNSYDVRLSTLEENLRKETEAVLQVGVLYKAEVMSRAEFASSAEYPPAFQYETVVKPKVFSTTDTLPSDDVSKTQVSSRFAELPKVEPSKSEISLGSSESSSLEETSVSEAFPGPEEPSNVEVSMPTEESRSRYFLDECLGQEAAGHLLGEQNYLPQEEPQEVPLQGLLGLQDPFAEVEAKLARLSSTVARTDAPQADVPKVPVQVPAPTDLLEPSDARPEAEAADDFPPRPEVDLASEVALEVVRTAEPGVWLEAQAPVALVAQPEPLPATAGVKRESVGMEVAVLTDDPLPVVDQQQVLARLQLLEQQVVGGEQAKNKDLKEKHKRRKRYADERRKQLVAALQNSDEDSGDWVLLNVYDSIQEEVRAKSKLLEKMQRKLRAAEVEIKDLQSEFQLEKIDYLATIRRQERDSMLLQQLLEQVQPLIRRDCNYSNLEKILRESCWDEDNGFWKIPHPVITKTSLPVVSTGPQNKPARKTSAADNGEPNMEDDRYRLMLSRSNSENIASNYFRSKRASQILSTDARKSLTHHNSPPGLSCPLSNNSAIPPTQAPEMPQPRPFRLESLDIPFTKAKRKKSKSNFGSEPL

SEQ ID NO: 7079 - protein, 306 aa, Homo sapiens
MRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 7080 - protein, 939 aa, Homo sapiens
MAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYCSILYLKPRMQIILRGQKVKTQLVSKSLAYIERDVYRPKFLSKTVRITFGFNCRNKDHYGIMMYHRNRLIKAYEKVGCQLRANNMGVGVVGIIECNFLKPTHNKQDFDYTNEYRLTITALGEKLNDYWNEMKVKKNTEYPLNLPVEDIQKRPDQTWVQCDACLKWRKLPDGMDQLPEKWYCSNNPDPQFRNCEVPEEPEDEDLVHPTYEKTYKKTNKEKFRIRQPEMIPRINAELLFRPTALSTPSFSSPKESVPRRHLSEGTNSYATRLLNNHQVPPQSEPESNSLKRRLSTRSSILNAKNRRLSSQFENSVYKGDDDDEDVIILEENSTPKPAVDHDIDMKSEQSHVEQGGVQVEFVGDSEPCGQTGSTSTSSSRCDQGNTAATQTEVPSLVVKKEETVEDEIDVRNDAVILPSCVEAEAKIHETQETTDKSADDAGCQLQELRNQLLLVTEEKENYKRQCHMFTDQIKVLQQRILEMNDKYVKKETCHQSTETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 7081 - protein, 382 aa, Homo sapiens; identical to SEQ ID NO: 6681

SEQ ID NO: 7082 - protein, 1685 aa, Homo sapiens
MSLPFYQRCHQHYDLSYRNKDVRSTVSHYQREKKRSAVYTQGSTAYSSRSSAAHRRESEAFRRASASSSQQQASQHALSSEVSRKAASAYDYGSSHGLTDSSLLLDDYSSKLSPKPKRAKHSLLSGEEKENLPSDYMVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLRKTLEETETYHAKLNEDHLLHAPEFIIKPRSHTVWEKENVKLHCSIAGWPEPRVTWYKNQVPINVHANPGKYIIESRYGMHTLEINGCDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIQWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEPVAALDPAEKARLKSRPSAPWTGQIIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEASVAGSGKWEPCNNNPVKGSRFTCHGLVTGQSYIFRVRAVNAAGLSEYSQDSEAIEVKAAIGGGVSPDVCPALSDEPGGLTASRGRVHEASPPTFQKDALLGSKPNKPSLPSSSQNLGQTEVSKVSETVQEELTPPPQKAAPQGKSKSDPLKKKTDRAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKKSLLFQKDRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 7083 - protein, 1151 aa, Homo sapiens [sequence omitted]

SEQ ID NO: 7084 - protein, 139 aa, Homo sapiens
MGGGERYNIPAPQSRNVSKNQQQLNRQKTKEQNSQMKIVHKKKERGHGYNSSAAAWQAMQNGGKNKNFPNNQSWNSSLSGPRLLFKSQANQNYAGAKFSEPPSPSVLPKPPSHWVPVSFNPSDKEIMTFQLKTLLKVQV

SEQ ID NO: 7085 - protein, 327 aa, Homo sapiens
MKEMLAKDLEESQGGKSSEVLSATELRVQLAQKEQELARAKEALQAMKADRKRLKGEKTDLVSQMQQLYATLESREEQLRDFIRNYEQHRKESEDAVKALAKEKDLLEREKWELRRQAKEATDHATALRSQLDLKDNRMKELEAELAMAKQSLATLTKDVPKRHSLAMPGETVLNGNQEWVVQADLPLTAAIRQSQQTLYHSHPPHPADRQAVRVSPCHSRQPSVISDASAAEGDRSSTPSDINSPRHRTHSLCNGDSPGPVQKNLHNPIVQSLEDLEDQKRKKKKEKMGFGSISRVFARGKQRKSLDPGLFDGTAPDYYIEEDADW

SEQ ID NO: 7086 - protein, 327 aa, Homo sapiens; identical to SEQ ID NO: 7085

SEQ ID NO: 7087 - protein, 202 aa, Homo sapiens
MDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVT

SEQ ID NO: 7088 - protein, 600 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKNGEERGRDASKKALGPRRDSDLGKEPKRGGLKKSFSRDRDEAGGKSGEKPKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKLELPLLLQ

SEQ ID NO: 7089 - protein, 66 aa, Homo sapiens
MIGTTEVPCCGPSATWALRWSDQITLPSLPWTMSSLWCIPLKGMLATCPVSLLEHAYSNALRGWKP

SEQ ID NO: 7090 - protein, 706 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 7091 - protein, 426 aa, Homo sapiens; identical to SEQ ID NO: 5381

SEQ ID NO: 7092 - protein, 331 aa, Homo sapiens
MLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLGESCQVQVGSLGDSSDVERLERFFDSEDEDFEILSL

SEQ ID NO: 7093 - protein, 486 aa, Homo sapiens; identical to SEQ ID NO: 4931

SEQ ID NO: 7094 - protein, 1024 aa, Homo sapiens; identical to SEQ ID NO: 6026

SEQ ID NO: 7095 - protein, 112 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLV

SEQ ID NO: 7096 - protein, 146 aa, Homo sapiens
MLKEDCASELKVHLAKSLPLPSSVNRPRIDLIVFVVNLHSKYSLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 7097 - protein, 400 aa, Homo sapiens
MASDTQAVPDVSGRSRARRYAEWSSGLRSGRAGGGETSVERRRTCAFDTLEAFLIMDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 7098 - protein, 232 aa, Homo sapiens
MTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVKQLQEELEGLGVASTLPGLRGCGDIGTIPLPKLHSLQSQLRLDLEAVDGVIFQLRAKQCVACRERAHGAVLRPCQHHILCEPCAATAPECPYCKGQPLQW

SEQ ID NO: 7099 - protein, 499 aa, Homo sapiens
MLPWPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 7100 - protein, 1050 aa, Homo sapiens; identical to SEQ ID NO: 4953

SEQ ID NO: 7101 - protein, 120 aa, Homo sapiens
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQGYLSSLEWVLVHIC

SEQ ID NO: 7102 - protein, 393 aa, Homo sapiens; identical to SEQ ID NO: 6238

SEQ ID NO: 7103 - protein, 75 aa, Homo sapiens
MSPQKRVKNVQAQNRTSQGSSSFQTTLSAWKVKQDPSNSKNISKHGQNNPVGDYEHADDQAEEDALQMAVGYFEK

SEQ ID NO: 7104 - protein, 331 aa, Homo sapiens
MAFVTRQFMRSVSSSSTASASAKKIIVKHVTVIGGGLMGAGIAQVAAATGHTVVLVDQTEDILAKSKKGIEESLRKVAKKKFAENLKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERDFQTCGDSNSGLGFSLKGDASKEDIDTAMKLGAGYPMGPFELLDYVGLDTTKFIVDGWHEMDAENPLHQPSPSLNKLVAENKFGKKTGEGFYKYK

SEQ ID NO: 7105 - protein, 426 aa, Homo sapiens; identical to SEQ ID NO: 5381

SEQ ID NO: 7106 - protein, 429 aa, Homo sapiens
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNAENWCYYEGLEKALQISTLEERLQIYEEISKQHPKAITPRRLPLTLVPGERFRELMDKFLRVNFSKGCPPLFTTLKSLYYNTEKVSIIQELVTNYEASLKTCDFFSPYENGEKEPPTTLLWVQYFLAQHFDKLGQYSLALDYINAAIASTPTLIELFYMKAKIYKVKSESCFLSS

SEQ ID NO: 7107 - protein, 119 aa, Homo sapiens
MDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVDIASAESSI

SEQ ID NO: 7108 - protein, 232 aa, Homo sapiens; identical to SEQ ID NO: 7098

SEQ ID NO: 7109 - protein, 486 aa, Homo sapiens; identical to SEQ ID NO: 4931

SEQ ID NO: 7110 - protein, 1024 aa, Homo sapiens; identical to SEQ ID NO: 6026

SEQ ID NO: 7111 - protein, 588 aa, Homo sapiens; identical to SEQ ID NO: 5480

SEQ ID NO: 7112 - protein, 221 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLR

SEQ ID NO: 7113 - protein, 299 aa, Homo sapiens; identical to SEQ ID NO: 5075

SEQ ID NO: 7114 - protein, 730 aa, Homo sapiens
MEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNKYLLTCKTARQLTVRIKNLNMNRAPDNIIKFYKKTKQLPVLGKCCEEIQPHQWKPPIEREEHRLPFWLKASLPSIQEELRHMADGAREVGNMTGTTEINSDQGLEKDNSELGSETRYPLLLPKGVVLKLKPVADRFPKKAWRQKRSSVLKPLLIQPSPSLQPSFNPGKTPAQSTHSEAPPSKMVLRIPHPIQPATVLQTVPGVPPLGVSGGESFESPAALPAMPPEARTSFPLSESQTLLSSAPVPKVMMPSPASSMFRKPYVRRRPSKRRGARAFRCIKPAPVIHPASVIFTVPATTVKIVSLGGGCNMIQPVNAAVAQSPQTIPIATLLVNPTSFPCPLNQPLVASSVSPLIVSGNSVNLPIPSTPEDKAHMNVDIACAVADGENAFQGLEPKLEPQELSPLSATVFPKVEHSPGPPPVDKQCQEGLSENSAYRWTVVKTEEGRQALEPLPQGIQESLNNSSPGDLEEVVKMEPEDATEEISGFL

SEQ ID NO: 7115 - protein, 520 aa, Homo sapiens
MFVSDFRKEFYEVVQSQRVLLFVASDVDALCACKILQALFQCDHVQYTLVPVSGWQELETAFLEHKEQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 7116 - protein, 188 aa, Homo sapiens; identical to SEQ ID NO: 5612

SEQ ID NO: 7117 - protein, 393 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 7118 - protein, 259 aa, Homo sapiens; identical to SEQ ID NO: 5295

SEQ ID NO: 7119 - protein, 283 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGEPPSWPISATARG

SEQ ID NO: 7120 - protein, 706 aa, Homo sapiens
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGPYLFGAGCFSIKAPWSYIMTKYIFYIKPPNKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAG

SEQ ID NO: 7121 - protein, 604 aa, Homo sapiens
MGGCFSKPKPGAALPTVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 7122 - protein, 247 aa, Homo sapiens
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPPPRGLALAPWKAPMGNTSPEGPLAGLGRVSLSPAMGWGEGSGAGRPGKEGRGWGPALGLPQGCVTSALLPAIANPGSGGVGSVGRKGWGRSGDCLGSWET

SEQ ID NO: 7123 - protein, 445 aa, Homo sapiens; identical to SEQ ID NO: 5097

SEQ ID NO: 7124 - protein, 444 aa, Homo sapiens
FRVPAAGRRCPLARGARRPPDSACGRFPPDPGSPPEEEDADLSEREESWLLAEREENQEAEFPGLRRAVQLNLSRPIEEQGPLDVIIHKLTDVILEADQNDSQSLELVHRFQEYIDAHPETIVLDPLPAIRTLLDRSKSYELIRKIEAYMEDDRICSPPFMELTSLCGDDTMRLLEKNGLTFPFICKTRVAHGTNSHEMAIVFNQEGLNAIQPPCVVQNFINHNAVLYKVFVVGESYTVVQRPSLKNFSAGTSDRESIFFNSHNVSKPESSSVLTELDKIEGVFERPSDEVIRELSRALRQALGVSLFGIDIIINNQTGQHAVIDINAFPGYEGVSEFFTDLLNHIATVLQGQSTAMAATGDVALLRHSKLLAEPAGGLVGERTCSASPGCCGSMMGQDAPWKAEADAGGTAKLPHQRLGCNAGVSPSFQQHCVASLATKASSQ

SEQ ID NO: 7125 - protein, 287 aa, Homo sapiens
MCGRRRRQRAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 7126 - protein, 283 aa, Homo sapiens
PPCSLISDCCAGNQRDSVGVGPSEPGCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGR

SEQ ID NO: 7127 - protein, 744 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 7128 - protein, 362 aa, Homo sapiens; identical to SEQ ID NO: 5396

SEQ ID NO: 7129 - protein, 709 aa, Homo sapiens
MADAGIRRVVPSDLYPLVLGFLRDNQLSEVANKFAKATGATQQDANASSLLDIYSFWLKSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKVWTITSVRAETVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 7130 - protein, 185 aa, Homo sapiens; identical to SEQ ID NO: 6123

SEQ ID NO: 7131 - protein, 587 aa, Homo sapiens; identical to SEQ ID NO: 5895

SEQ ID NO: 7132 - protein, 365 aa, Homo sapiens
MKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTMAGGLGLNFVGANVVVLFDPTWNPANDLQAIDRTQTHCRRERDAEPLSSAPGLQNGSENAVPYPWWCCVTGASISCWRCEICRIQDVLE

SEQ ID NO: 7133 - protein, 367 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 7134 - protein, 587 aa, Homo sapiens; identical to SEQ ID NO: 5895

SEQ ID NO: 7135 - protein, 380 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLGESCQVQILLM

SEQ ID NO: 7136 - protein, 707 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 7137 - protein, 341 aa, Homo sapiens; identical to SEQ ID NO: 5889

SEQ ID NO: 7138 - protein, 495 aa, Homo sapiens
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEASSTRICLKELGTFAQSSIALHHQYNPKFQTLFQPCNLMGAMQLIEDFSTHVSIDCSPHKTVKKTANEFPCLPKQVAWILATSKVFMYPELLPVCSLKAKNPQDKILFTKAEDNLLALGLKHFEGTEFLNPLISKYLLTCKTARQLTVRIKNLNMNRAPDNIIKFYKKTKQLPVLGKCCEEIQPHQWKPPIEREEHRLPFWLKVQPSSSKSVGGRRSLKVLREYQGLP

SEQ ID NO: 7139 - protein, 59 aa, Homo sapiens
MAAPGALLVMGVSGSGNWDGNSMMLMIITRRKIEGRWEKAYRSMTRTGFHGSVTCMTFY

SEQ ID NO: 7140 - protein, 68 aa, Homo sapiens
MGETEGKKDEADYKRLQTFPLVRHSDMPEEMRVETMELCVTACEKFSNNNEVLPAVQAAPRAFDGPCG

SEQ ID NO: 7141 - protein, 816 aa, Homo sapiens; identical to SEQ ID NO: 6220

SEQ ID NO: 7142 - protein, 372 aa, Homo sapiens; identical to SEQ ID NO: 5421

SEQ ID NO: 7143 - protein, 159 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVVRGPQNNVRSLGISVSALVS

SEQ ID NO: 7144 - protein, 80 aa, Homo sapiens
MASEELQKDLEEVKVLLEKATRKRVRDALTAEKSKIETEIKNKMQQKSQKKAELLDNEKPAAVVAPITTGYTDGISQISL

SEQ ID NO: 7145 - protein, 201 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPVSCCLGLLLESLVPFIVNDNITNNFFRFLCMT

SEQ ID NO: 7146 - protein, 466 aa, Homo sapiens
MSYRPVVSPVMSLTRRCMRSRTSMRTDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 7147 - protein, 198 aa, Homo sapiens
MSRAVTIAEAFCHILFRIISEILMRMLEEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 7148 - protein, 146 aa, Homo sapiens
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVAKDVTLHQALLRLPQYQTDLLLTFNQPP

SEQ ID NO: 7149 - protein, 527 aa, Homo sapiens
MSLCGARANAKMMAAYNGGTSAAAAGHHHHHHHHLPHLPPPHLHHHHHPQHHLHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 7150 - protein, 913 aa, Homo sapiens
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 7151 - protein, 719 aa, Homo sapiens; identical to SEQ ID NO: 5328

SEQ ID NO: 7152 - protein, 107 aa, Homo sapiens
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGGGRL

SEQ ID NO: 7153 - protein, 532 aa, Homo sapiens
MFVLGIPLCPALSFSGGDDSQTQLFVSSKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 7154 - protein, 460 aa, Homo sapiens; identical to SEQ ID NO: 5990

SEQ ID NO: 7155 - protein, 188 aa, Homo sapiens; identical to SEQ ID NO: 5612

SEQ ID NO: 7156 - protein, 531 aa, Homo sapiens [sequence omitted]

SEQ ID NO: 7157 - protein, 362 aa, Homo sapiens
MTGHTRSSLPRCTGIVLLIKLRFSERLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 7158 - protein, 445 aa, Homo sapiens; identical to SEQ ID NO: 5667

SEQ ID NO: 7159 - protein, 134 aa, Homo sapiens
MSENAAPGLISELLLQRGTTKVATGLVLNRDQRLAWAENSIDFISRELCAHSIRKLQAHVLLIKAVHGYFDSRQNYSEKESLSFMIDTMKSTLKEQFQFVEVPGNHCVHMSEPQHVASIISSFLQCTHMLPAQL

SEQ ID NO: 7160 - protein, 106 aa, Homo sapiens
MSSKGSSTDGRTDLANGSLSSSPEEMSGAEEGRETSSGIEVEASDLSLSLTGDDGGPNRTSTESRGTDTESSGEDKDSDSMEDTGHYSINDENRVHDRSEEEEEEE

SEQ ID NO: 7161 - protein, 329 aa, Homo sapiens; identical to SEQ ID NO: 5296

SEQ ID NO: 7162 - protein, 744 aa, Homo sapiens
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKEFGISPSDIPFSQGSGSRPDLSPSYEYDDFSPSVTRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 7163 - protein, 566 aa, Homo sapiens; identical to SEQ ID NO: 4930

SEQ ID NO: 7164 - protein, 265 aa, Homo sapiens; identical to SEQ ID NO: 4884

SEQ ID NO: 7165 - protein, 935 aa, Homo sapiens
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTDTALDVAVKTFPPERHVAVKCFELQREGSIETLSNSSGSTSGSIPRNFDGYRSPLPTNESQPLSLFPTGFP

SEQ ID NO: 7166 - protein, 204 aa, Homo sapiens
MEAAGSPAATETGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 7167 - protein, 220 aa, Homo sapiens
MSSGNYQQSEALSKPTFSEEQASALVESVFGLKVSKVRPLPSYDDQNFHVYVSKTKDGPTEYVLKISNTKASKNPDLIEVQNHIIMFLKAAGFPTASVCHTKGDNTASLVSVDSGSEIKSYLVRLLTYLPGRPIAELPVSPQLLYEIGKLAAKLDKTLQRFHHPKLSSLHRENFIWNLKNVPLLEKYLYALGQNRNREIVEHVIHLFKEEVMTKLSHFRE

SEQ ID NO: 7168 - protein, 200 aa, Homo sapiens
MSSDSMDQPRNPCENEPLTPGYHGFPARDSQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEG

SEQ ID NO: 7169 - protein, 128 aa, Homo sapiens
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKISVLNSVTVAKSP

SEQ ID NO: 7170 - protein, 130 aa, Homo sapiens
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKSLQNDDLFKTDCHHQ

SEQ ID NO: 7171 - protein, 507 aa, Homo sapiens
MWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 7172 - protein, 560 aa, Homo sapiens
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGFAAFGQTKPVVTPFGQVAAAGVSSNPFMTGAPTGQFPTGSSSTNPFL

SEQ ID NO: 7173 - protein, 800 aa, Homo sapiens; identical to SEQ ID NO: 6467

SEQ ID NO: 7174 - protein, 47 aa, Homo sapiens
MDDQQALNSIMQDLAVLHKASRPALSLQETRKAKSSSPKKQNDVRVK

SEQ ID NO: 7175 - protein, 423 aa, Homo sapiens
MVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 7176 - protein, 372 aa, Homo sapiens; identical to SEQ ID NO: 4942

SEQ ID NO: 7177 - protein, 303 aa, Homo sapiens
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGTLDHMVDQVTRSVAFVQKRYPSNKGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFHRQSWEFYQTLCQGEWKASFEELHDVDHFEIVENLTQKDNVLTQIILKTIFQ

SEQ ID NO: 7178 - protein, 227 aa, Homo sapiens
MALHDMEDFTFDGTKRLSVNYVKGILQPTDTCDIWDKIWNFQAKPDDLLISTYPKAGTTWTQEIVELIQNEGDVEKSKRAPTHQRFPFLEMKIPSLGSVCWGSWHEHVKGWWEAKDKHRILYLFYEDMKKNPKHEIQKLAEFIGKKLDDKVLDKIVHYTSFDVMKQNPMANYSSIPAEIMDHSISPFMRKGAVGDWKKHFTVAQNERFDEDYKKKMTDTRLTFHFQF

SEQ ID NO: 7179 - protein, 121 aa, Homo sapiens
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKSKFSIP

SEQ ID NO: 7180 - protein, 88 aa, Homo sapiens
LSFRADSAHASMVNVPKTRRTFCKKCGKHQPHKVTQYKKGKDSLYAQGKRRYDRKQSGYGGQTKPIFRKKLHQNCIEPNLPPRAQQSP

SEQ ID NO: 7181 - protein, 193 aa, Homo sapiens; identical to SEQ ID NO: 4761

SEQ ID NO: 7182 - protein, 1378 aa, Homo sapiens
MSLERELRQLSKAKAKAQRAGQRREEAALCHQLGELLAGHGRYAEALEQHWQELQLRERADDPLGCAVAHRKIGERLAEMEDYPAALQHQHQYLELAHSLRNHTELQRAWATIGRTHLDIYDHCQSRDALLQAQAAFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSEGEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 7183 - protein, 405 aa, Homo sapiens
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGLPFFVLALTASTYLRPAGARARQSSPWPGPRGGQTSPHCAEGPQSAQLSGAMMN

SEQ ID NO: 7184 - protein, 414 aa, Homo sapiens; identical to SEQ ID NO: 4779

SEQ ID NO: 7185 - protein, 214 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRAAEKAGMSAEQAQGLLEKIATPKVKNQLKETTEAACRYGAFGLPITVAHVDGQTHMLFGSDRMELLAHLLGEKWMGPIPPAVNARL

SEQ ID NO: 7186 - protein, 1401 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 7187 - protein, 465 aa, Homo sapiens; identical to SEQ ID NO: 4947

SEQ ID NO: 7188 - protein, 1069 aa, Homo sapiens
MYLLDGSGEPASPPADAMPRGTPPRKTVYRISVTMVRKEQLAAPGSGGPDPRPVRRPRPARSPDAPGRLEEEAEEAEGAEEPEGPRPRAWDFRTFRTRSTGQLELGRLRPCARGLEPADLAGSAPAEEEGRGSPASGSPDVEGARAAPLRRSLSFRHWSGPEAPQGRTLGGGRRHSSSGSLAWAPCDEAAAGTTLEPATATQPASEKRNTLDVGEVLSKNDALSDLERWERSKSKNRTLDNSDLQRLERARAAAGAGAASEHRLLRFFSGIFARRDGGPGGGPSPRSGASRPRGYFSLRRAPAEAHSSSAESIDGSPRRDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 7189 - protein, 419 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 7190 - protein, 922 aa, Homo sapiens; identical to SEQ ID NO: 6366

SEQ ID NO: 7191 - protein, 120 aa, Homo sapiens
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNCHHQ

SEQ ID NO: 7192 - protein, 125 aa, Homo sapiens; identical to SEQ ID NO: 5223

SEQ ID NO: 7193 - protein, 499 aa, Homo sapiens
MSTPSGISTWLSLPVSTPASITSIRVTQKSSGPWAFSSCTYVSGPGVCISSLSCSRVGSSSFRGGLGGGYGGASGMGGIIAIMVNQSLLSPLNLEVDPNIQAVCTQEKEQIKTLNNKFASFIDKVWFLEQQNKVLETKWSLLQQQKMARSNMDNMLESYINNLRRQLETLGQEKLKLEAELGNMQGLGEDFKNKYEDEINKHTEVENEFVLIKKDVDEAYMNKAELESLLEGLTDEINFLRQLYEEEIRELQSQISDMSMVLSMDYSCSRDMDSIIPEVKVQYEEIANCSRAEAESMYQIKYEELQTLAGKYGDDLSRTKTEISEMNRNISWLQAETEGLKGQRASLEAAITDAEQRGELAVKDANAKLSELEAALQRAKQDMMGQLREYQELMNVGLTLDIEIATYRKLLEGEESRLESGMQNVSIHTKTTSSYAGGLSSAYGGLTSPGIIYRLGSSFGSAAGSSSFSRTSSTRAVVVRKIETHDGKLESESSDVLSK

SEQ ID NO: 7194 - protein, 167 aa, Homo sapiens
MYMGMMCTAKKCGIRFQPPAIILIYESEIKGKIRQRIMPVRNFSKFSDCTRAAEQLKNNPRHKSYLEQVSLRQLEKLFSFLRGYLSGQSLAETMEQIQRETTIDPEEDLNKLDDKELAKRKSIMDELFEKNQKKKDDPNFVYDIEVEFPQDDQLQSCGWDTESADEF

SEQ ID NO: 7195 - protein, 125 aa, Homo sapiens [sequence omitted]

SEQ ID NO: 7196 - protein, 334 aa, Homo sapiens
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEMYEQVRKSLEMCSIQRDIEYFVNQRKTGQIPPAPIMYENFYSSQKNAVPAGKATGPNLARRGPLPIPKSSPDDPNYSLVDDYSLLYQ

SEQ ID NO: 7197 - protein, 198 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSV

SEQ ID NO: 7198 - protein, 374 aa, Homo sapiens
MLAPGCELDPDQEVVRTRPEDVPASPSTSTMIVSVLRPPSHASCTACGTVTFHIVERMASVIPASNRSMRSDRNTYVGKRFVHVKNPYLDLMDEDILYHLDLGTKTHNLPAMFGDVKFVCVGGSPNRMKAFALFMHKELGFEEAEEDIKDICAGTDRYCMYKTGPVLAISHGMGIPSISIMLHELIKLLHHARCCDVTIIRIGTSGGIGIAPGTVVITDIAVDSFFKPRFEQVILDNIVTRSTELDKELSEELFNCSKEIPNFPTLVGHTMCTYDFYEGQGRLDGALCSFSREKKLDYLKRAFKAGVRNIEMESTVFAAMCGLCGLKAAVVCVTLLDRLDCDQINLPHDVLVEYQQRPQLLISNFIRRRLGLCD

SEQ ID NO: 7199 - protein, 1382 aa, Homo sapiens
MLRKLTIEQINDWFTIGKTVTNVELLGAPPAFPAGAAREEVQRQDVAPGAGPAAQAPALAQAPARPAAAFERSLSQRSSEVEYINKYRQLEAQELDVCRSVQPTSGPGPRPSLAKLSSVTCIPGTTYKYPDLPISRYKEEVVSLIESNSVVIIHGATGSGKSTQLPQYILDHYVQRSAYCSIVVTQPRKIGASSIARWISKERAWTLGGVVGYQVGLEKIATEDTRLIYMTTGVLLQKIVSAKSLMEFTHIIIDEVHERTEEMDFLLLVVRKLLRTNSRFVKVVLMSATISCKEFADYFAVPVQNKMNPAYIFEVEGKPHSVEEYYLNDLEHIHHSKLSPHLLEEPVITKDIYEVAVSLIQMFDDLDMKESGNKAWSGAQFVLERSSVLVFLPGLGEINYMHELLTSLVHKRLQVYPLHSSVALEEQNNVFLSPVPGYRKIILSTNIAESSVTVPDVKYVIDFCLTRTLVCDEDTNYQSLRLSWASKTSCNQRKGRAGRVSRGYCYRLVHKDFWDNSIPDHVVPEMLRCPLGSTILKVKLLDMGEPRALLATALSPPGLSDIERTILLLKEVGALAVSGQREDENPHDGELTFLGRVLAQLPVNQQLGKLIVLGHVFGCLDECLIIAAALSLKNFFAMPFRQHLDGYRNKVNFSGSSKSDCIALVEAFKTWKACRQTGELRYPKDELNWGRLNYIQIKRIREVAELYEELKTRISQFNMHVDSRRPVMDQEYIYKQRFILQVVLAGAFYPNYFTFGQPDEEMAVRELAGKDPKTTVVLKHIPPYGFLYYKQLQSLFRQCGQVKSIVFDGAKAFVEFSRNPTERFKTLPAVYMAIKMSQLKVSLELSVHSAEEIEGKVQGMNVSKLRNTRVNVDFQKQTVDPMQVSFNTSDRSQTVTDLLLTIDVTEVVEVGHFWGYRIDENNSEILKKLTAEINQLTLVPLPTHPHPDLVCLAPFADFDKQRYFRAQVLYVSGNSAEVFFVDYGNKSHVDLHLLMEIPCQFLELPFQALEFKICKMRPSAKSLVCGKHWSDGASQWFASLVSGCTLLVKVFSVVHSVLHVDVYQYSGVQDAINIRDVLIQQGYAELTEESYESKQSHEVLKGLFSKSVENMTDGSVPFPMKDDEKYLIRILLESFSTNKLGTPNCKAELHGPFNPYELKCHSLTRISKFRCVWIEKESINSVIISDAPEDLHQRMLVAASLSINATGSTMLLRETSLMPHIPGLPALLSMLFAPVIELRIDQNGKYYTGVLCGLGWNPATGASILPEHDMELAFDVQFSVEDVVEVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 7200 - protein, 118 aa, Homo sapiens
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 7201 - protein, 1075 aa, Homo sapiens; identical to SEQ ID NO: 5935

SEQ ID NO: 7202 - protein, 126 aa, Homo sapiens
MTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 7203 - protein, 936 aa, Homo sapiens; identical to SEQ ID NO: 4771

SEQ ID NO: 7204 - protein, 619 aa, Homo sapiens; identical to SEQ ID NO: 5784

SEQ ID NO: 7205 - protein, 170 aa, Homo sapiens
MTRGNQRELARQKNMKKQSDSVKGKRRDDGLSAAARKQRVGVQQPNAELSPIHFHLILCALHPPASCPFCPLVPPSAPSSLPPGTRRSCSRSRKRQTRRRRNPSSFVASCPTLLPFACVPGASPTTLAFPPVVLTGPSTDGIPFALSLQRVPFVLPSPQVASLPLGHSRG

SEQ ID NO: 7206 - protein, 209 aa, Homo sapiens; identical to SEQ ID NO: 4887

SEQ ID NO: 7207 - protein, 584 aa, Homo sapiens
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTAFRMLSSSCSFGEFTSAFPLQATHSGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGFAAFGQTKPVVTPFGQVAAAGVSSNPFMTGAPTGQFPTGSSSTNPFL

SEQ ID NO: 7208 - protein, 264 aa, Homo sapiens; identical to SEQ ID NO: 5819

SEQ ID NO: 7209 - protein, 501 aa, Homo sapiens
MSSEQDKSASKEKSKKPVRFLPQLSMEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIMQQDADLDSAVPDGSTIPKPTASAIEKDILRYYYYIHHGIDTDHVAPMEDSWLEHVLDLVPQHLKVFTDSIVTLSDEMREDYLLSVRKSIVDFVLKDPREKGDDKKTDELPAHRAEMEILPKPWRKSFLAASSYIRDHLNAMNPTMLAVLDLWHTNFKKLRLVDIKEFHNCQDALELSSFQNIIMRHMDSAKETLLKMWFPEVQNIYYQGNKKKQLPTGDSSAKLESFFNCAAALMTLQLQDLTLVSMQDFTDLIAQPPDSVRAFEHPGFIMRLILDNDTIKFEPELSDYIDIFLNVYDVMIKAVSFVPRVETKLYSKWRNKAKPGHFYFSHIQRSVTFQHSEVSSPQNSHFKIVSPFSVLGFTWRCQL

SEQ ID NO: 7210 - protein, 284 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 7211 - protein, 244 aa, Homo sapiens
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSVSLLILAGLHSVLKSFLGRMWWFMPVIPATREAEARESLELRRQRLQ

SEQ ID NO: 7212 - protein, 294 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIG

SEQ ID NO: 7213 - protein, 457 aa, Homo sapiens; identical to SEQ ID NO: 7040

SEQ ID NO: 7214 - protein, 545 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQQIARPSQEEKVEEKEEDKAEKTEKKEEEKKDEEEKDEKEDS

SEQ ID NO: 7215 - protein, 159 aa, Homo sapiens
MTHCCSPCCQPTCCRTTCWQPTTVTTCSSTPCCQPSCCVSSCCQPCCHPTCCQNTCCRTTCCQPICVTSCCQPSCCSTPCCQPTCCGSSCGQSSSCAPVYCRRTCYHPTSVCLPGCLNQSCGSNCCQPCCRPACCETTCCRTTCFQPTCVYSCCQPSCC

SEQ ID NO: 7216 - protein, 356 aa, Homo sapiens
MEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 7217 - protein, 61 aa, Homo sapiens
MPFFGNTFSPKKTPPRKSASLSNLHSLDRSTREVELGLEYGSPTMNLAGQSLKFENGQWIA

SEQ ID NO: 7218 - protein, 326 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDG

SEQ ID NO: 7219 - protein, 676 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 7220 - protein, 152 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGH

SEQ ID NO: 7221 - protein, 255 aa, Homo sapiens
MWPFPSRSLFPPPTQAWLQTVSSDPEAQGWGAWNETKEILGPEGGEGKEEKEEEEDAEEDQDGDAGFLLSLLEQENLAECPLPDQELEAIKMKVCAMEQAEGTPRPPGVQQQAEEEEGTAAGQLLSPETVGCPLSGTPEEKVEADHRSVYVGNVDYGGSAEELEAHFSRCGEVHRVTILCDKFSGHPKGCCRKEPTSLGSAPQTAGAFEDTQAPGGHPSPTAASRAGPGSDHKGRTGPVENSHHGFHRIKGKTRF

SEQ ID NO: 7222 - protein, 1186 aa, Homo sapiens
MEKATVPVAAATAAEGEGSPPAVAAVAGPPAAAEVGGGVGGSSRARSASSPRGMVRVCDLLLKKKPPQQQHHKAKRNRTCRPPSSSESSSDSDNSGGGGGGGGGGGGGGGTSSNNSEEEEDDDDEEEEVSEVESFILDQDDLENPMLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVRKLLIEGRSVNEHTEEGESLLCLACSAGYYELAQVLLAMHANVEDRGIKGDITPLMAAANGGHVKIVKLLLAHKADVNAQSSTGNTALTYACAGGYVDVVKVLLESGASIEDHNENGHTPLMEAGSAGHVEVARLLLENGAGINTHSNEFKESALTLACYKGHLEMVRFLLEAGADQEHKTDEMHTALMEACMDGHVEVARLLLDSGAQVNMPADSFESPLTLAACGGHVELAALLIERGASLEEVNDEGYTPLMEAAREGHEEMVALLLGQGANINAQTEETQETALTLACCGGFLEVADFLIKAGADIELGCSTPLMEAAQEGHLELVKYLLAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAASKQKSSSHLPANSQDVQGYITNQSPESIVEEAQGKLTELEQRIKEAIEKNAQLQSLELAHADQLTKEKIEELNKTREEQIQKKQKILEELQKVERELQLKTQQQLKKQYLEVKAQRIQLQQQQQQSCQHLGLLTPVGVGEQLSEGDYARLQQVDPVLLKDEPQQTAAQMGFAPIQPLAMPQALPLAAGPLPPGSIANLTELQGVIVGQPVLGQAQLAGLGQGILTETQQGLMVASPAQTLNDTLDDIMAAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKSTGMFLITHL

SEQ ID NO: 7223 - protein, 893 aa, Homo sapiens
MAATVEGPELEAAAAAGDASEDSDAGSRALPFLGGNRLSLDLYPGGCQQLLHLCVQQPLQLLQVEFLRLSTHEDPQLLEATLAQLPQSLSCLRSLVLKGGQRRDTLGACLRGALTNLPAGLSGLAHLAHLDLSFNSLETLPACVLQMRGLGALLLSHNCLSELPEALGALPALTFLTVTHNRLQTLPPALGALSTLQRLDLSQNLLDTLPPEIGGLGSLLELNLASNRLQSLPASLAGLRSLRLLVLHSNLLASVPADLARLPLLTRLDLRDNQLRDLPPELLDAPFVRLQGNPLGEASPDAPSSPVAALIPEMPRLFLTSDLDSFPVTPQGCSVTLACGVRLQFPAGATATPITIRYRLLLPEPGLVPLGPHDALLSHVLELQPHGVAFQQDVGLWLLFTPPQARRCREVVVRTRNDNSWGDLETYLEEEAPQRLWAHCQVPHFSWFLVVSRPVSNACLVPPEGTLLCSSGHPGVKVIFPPGATEEPRRVSMQVVRMAGRELQALLGEPEAAVSPLLCLSQSGPPSFLQPVTVQLPLPSGITGLSLDRSRLHLLYWAPPAATWDDITAQVVLELTHLYARFQVTHFSWYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVSFYRGAVPVRVPEEAEAARQRKGADALWMATLPIKLPRLRGSEGPRRGAGLSLAPLNLGDAETGFLTQSNLLSVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 7224 - protein, 493 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEGKFDKFLEERAKAADRLPNLSSPSAEGPPGPPSGPAPRKKTQEKDDDMLFAL

SEQ ID NO: 7225 - protein, 220 aa, Homo sapiens
MNSQPQTRSPPSRTVPIHCTDNWKRRKVLEQTPVYRSLAGRGWIKYCIFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQ

SEQ ID NO: 7226 - protein, 137 aa, Homo sapiens
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIK

SEQ ID NO: 7227 - protein, 2602 aa, Homo sapiens
MKRKVVNTHKLRLSPNEEAFILKEDYERRRKLRLLQVREQERDIALQIREDIKQRRNQQFTRLAEELRAEWEESQTQKIQNLEKLYLASLRSMGEGHRQAKENEPDLDALAQRAAERKRKADLRHKEALKVQKNQKEILLKQKTWHIKARKEALLVEKERSAKITSLPPPPPTLFENIEVKRISAVKTNSSTYHHLHTFVNRETDTKRPDARLAAEEEAKRLEELQKQAAQERMERFEKAHVRGFQAMKKIHLAQNQEKLMKELKQLQQEDLARRRQTVAQMPPQLVELPYKRSEMKEDWQRELEFAFEDMYNADRKVKGNLILHLEPEPLPTVTNQIQDEELDLSMEQENLGAAEDLPVTEAEICSSETDVPLVMKTQQIPSKVLFKKLLNKIRSQKSLWTIKSMSEDESEMITTVSEIESKAPTVESGTIASKERTLSSGQEQVVESDTLTIESGPLASEDKPLSCGTNSGKEQEINETLPITTVAQSSVLLHPQEAAARIRMSARQKQIMEIEEQKQKQLELLEQIEQQKLRLETDCFRAQLEEEKRKKTQPTGVGIAPASCPVISDEDSHRQMIRNYQHQLLQQNRLHRQSVETARKQLLEYQTMLKGRCPSVSAPSLITDSVISVPSWKSERPTAISEHWDQGQRLKLSPNKYQPIQPIQTSKLEQDHFQVARQNHFPQRQVETTETLRASDILTNQALESQEHLRQFSQTETQQRDYKLVPKDSETLSRALSHDRQLISQDARKISETFGATTFQSLESQQLFSENSENISYHLTEPSSFVPLVPQHSFSSLPVKVESGKIQEPFSAMSKSTVSTSHSIISQMHDRPLLPSENITAQQGNMKALQEQLDLQKKVLQATQEAQEQLLLCKQKEVEQQTGLSVFLPLVTPDSSALLPSAKADLGRIQESSPTKNNIAVSSDHHVISQLQDKRLSLSQPILSQQNNFKFLQEQLNIQKDSLQARREAQEVLYVHKQSELDRRVCSEQAEPSFPFQVAQHTFTSLPSADTKSGKIQEQHSSKSEKGLVSCQSDIPISQDGSLSFLQQFLPLHDSLKLLQEQLTKQRDTLQARHEAQVELLLHRQRDLGDSKSGLVSSSSSPVVVQHSVASQASAKAEPRRIQELYLSEKENVGPSCHLIIPTFQDKSLSFPQHSLAQQENLTILQEQSQIQRVILGAKEGTQEFVHTESELEKRISSEQTGTSSSLSQVDESERFQECISIKSDSTIPLSHPKIPRCQERLLRVSQHMLPLQDNLEEHQAWLDTEKEAFHFSQKTQENTSSEQTGSSSFIPQLVQLSFTSLASAESGTILEPLFTESESKIFSSHLQIPQLQDRLLRISQLIQPQQDNLKALQEQLATQREAIILARQEAREELLLHQSEWEGRISPEQVDTSSLPLVPQHSFASLPLNESERNQEPCSINSDNIVSSGHSEIPTLPDGLLGLSHLVLPQQDNLIALEEHLHAQTDFLPSIEKTQKELVLSKPCKFEEKVSSEHFIQSHHGDLQALQQQLDTQKKAIRSIQEVQEELLLQRLSELEKRVSSEQVCSSSFVSQVPVADSERTQKSFPTKSNDTLPSSHREIPRLQDRLLSLSKPILPQQDNMTAQLDAQREVMYSYEKPQEELSLNKQRKLNKSESAEHTIPSLFLPKETEHSFIPLPFAEAKPKSTCELYSSQNEHAAPPSNPVIPGFQDRLLSFSQSVLTQQDNLGLQKQLDLQREVLHYSQKAQEKLLVQRQTALQQQIQKHEETLKDFFKDSQISKPTVENDLKTQKMGQLRDWFPNTQDLAGNDQENIRHADRNNSDDNHLASEDTSAKQSGEHLEKDLGRRSSKPPVAKVKCGLDLNQHELSAIQEVESPAIGRTSILGKPGIYEDRDPLRVSISREQSFFGSPLAHDPFSCLQLVGQENVCGDDYDEAVKLKESVVENHAVLSYAVEEEHAYLGPTVKPDDKAKTLSYEPLSSATVSTGSLLSYENTDLSLTDPESFSEHMDDSKQESTTSKEEETNIISSIVPSTQDIYQRQNSSDVHKSLLPAVDETTCGHTHFQQMIDKYINEANLIPEKTDLQELEHIFPNLHHQLFKPLEPHPDFDLSSSSSGISPDNRDFYQRSDSSSESHCATGLSKSTVYFTALRRTSMHSSLNTSPNQQPDTNLAHVGAHSFATENIIGGSEQCFEQLQPEYSSQEESQHADLPSIFSIEARDSSQGMKNQNYPSEEHTEILQNKKKIVHFQLSIGNLSSVYSSSDEANVFDQLNVQHSTPCGSNSSECSTKHQLESRKESMGFEELSKRGVVTMLQSQGLIEDNKNETCRVLDINPQVEETDSRLCVRTVEMGTSIQAPYSLTTQNEKYFENSAETDIPKITKKLSQLGESELFASSGSFSLQSSIPVWETETGHGIMEEPELTLISTTDTSIAEMDFANLTLEEKSENEAKCFFQVSEFLPLVSATEASDYPAVSELSIEKPRTASTAETPRRLTPVPGSLQEAFIKRKKSFMERSHQRQKEIRNKIHVSENSQIKTVKEKPSISSSVSRLKGVNKVRASFPEDRKTTQALRHQRGLRLYNQLAEVKQQKEEKTKQEAYAQNRARAKEFHKKTLEKLRAKNTC

SEQ ID NO: 7228 - protein, 533 aa, Homo sapiens
SAPSVGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEAYMKLGRNVARTFLDYYRLNPVVEKVAIPMPRLRNKEIEVQRRKEKSPPYKHPLLRGPASNYPNSKGDKKSSVNHKDPSTPFKTRSPGRSYGDRSMHFLLGNEINHSSLASKDLWINA

SEQ ID NO: 7229 - protein, 502 aa, Homo sapiens
MPEIRVTPLGACPVLSWNLVLPPGRGSRAPSSTDTRTGFHVLPHGVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 7230 - protein, 456 aa, Homo sapiens
MADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 7231 - protein, 89 aa, Homo sapiens; identical to SEQ ID NO: 6950

SEQ ID NO: 7232 - protein, 150 aa, Homo sapiens
MHPEDSVVSSKVLGCSHFPVASRPAGSHDPQPGHRGRVLGPARAPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTL

SEQ ID NO: 7233 - protein, 177 aa, Homo sapiens
MGCCGCSRGCGSGCGGCGSSCGGCGSGCGGCGSGRGGCGSGCGGCSSSCGGCGSRCYVPVCCCKPVCSWVPACSCTSCGSCGGSKGGCGSCGGSKGGCGSCGGSKGGCGSCGCSQSSCCKPCCCSSGCGSSCCQSSCCKPCCCQSSCCVPVCCQSSCCKPCCCQSNCCVPVCCQCKI

SEQ ID NO: 7234 - protein, 97 aa, Homo sapiens
MPAELWLTSYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 7235 - protein, 87 aa, Homo sapiens
MENQLAKSTEERTFQYQDSLPSLPVPSLEESLKKYLESVKPFANQEEYKKTEEIVQKFQSGIGEKLHQKLLERAKGKRNWVFVVIIE

SEQ ID NO: 7236 - protein, 626 aa, Homo sapiens; identical to SEQ ID NO: 6327

SEQ ID NO: 7237 - protein, 979 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 7238 - protein, 339 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 7239 - protein, 129 aa, Homo sapiens; identical to SEQ ID NO: 6440

SEQ ID NO: 7240 - protein, 564 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 7241 - protein, 262 aa, Homo sapiens; identical to SEQ ID NO: 5940

SEQ ID NO: 7242 - protein, 541 aa, Homo sapiens; identical to SEQ ID NO: 5657

SEQ ID NO: 7243 - protein, 100 aa, Homo sapiens
MSTIGSFEGFQAVSLKQEGDDQPSETDHLSMEEEDPMPRQISRQSSVTESTLYPNPYHQPYISRKYFATRPGAIETAMEDLKGHVAETSGETIQGFWLLT

SEQ ID NO: 7244 - protein, 474 aa, Homo sapiens
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 7245 - protein, 229 aa, Homo sapiens [sequence omitted]

SEQ ID NO: 7246 - protein, 549 aa, Homo sapiens
MSRVAKYRRQVSEDPDIDSLLETLSPEEMEELEKELDVVDPDGSVPVGLRQRNQTEKQSTGVYNREAMLNFCEKETKKLMQREMSMDESKQVETKTDAKEEKIIRGIDKGRVRAAVDKKEAGKDGRGEERAVATKKEEEKKGSDRNTGLSRDKDKKREEMKEVAKKEDDEKVKGERRNTDTRKEGEKMKRAGGNTDMKKEDEKVKRGTGNTDTKKDDEKVKKNEPLHEKEAKDDSKTKTPEKQTPSGPTKPSEGPAKVEEEAAPSIFDEPLERVKNNDPEMTEVNVNNSDCITNEILVRFTEALEFNTVVKLFALANTRADDHVAFAIAIMLKANKTITSLNLDSNHITGKGILAIFRALLQNNTLTELRFHNQRHICGGKTEMEIAKLLKENTTLLKLGYHFELAGPRMTVTNLLSRNMDKQRQKRLQEQRQAQEAKGEKKDLLEVPKAGAVAKGSPKPSPQPSPKPSPKNSPKKGGAPAAPPPPPPPLAPPLIMENLKNSLSPATQRKMGDKVLPAQEKNSRDQLLAAIRSSNLKQLKKVEVPKLLQ

SEQ ID NO: 7247 - protein, 76 aa, Homo sapiens
MSASCDGCVGSRPPVHLASGYSLADLLVLEMGMGTQCWTEDQRRWSSLWPWSHLSSDPSLPNVQVTRLTLLSEQAP

SEQ ID NO: 7248 - protein, 471 aa, Homo sapiens
MANSFAARIFTTLSDLQTNMANLKVIGIVIGKTDVKGFPDRKNIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPDIPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCTVHEFLAMTDEQKTALKWQFLLERSKIYLKFVLSHRARSGLKISVLSCKLADPTEASRNLSGQKHV

SEQ ID NO: 7249 - protein, 248 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQ

SEQ ID NO: 7250 - protein, 881 aa, Homo sapiens
MFWKFDLHTSSHLDTLLEREDLSLPELLDEEDVLQECKVVNRKLLDFLLQPPHLQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVVNWLNEEKIVQRLIEQIHPSKDENQHSNASQSLCDIIRLSREQMIQVQDSPEPDQLLATLEKQETIEQLLSNMFEGEQSQSVIVSGIQVLLTLLEPRRPRSESVTVNSFFSSVDGQLELLAQGALESTVSSVGALHALRPRLSCFHQLLLEPPKLEPLQMTWGMLAPPLGNTRLHVVKLLASALSANDAALTHELLALDVPNTMLDLFFHYVFNNFLHAQVEGCVSTMLSLGPPPDSSPETPIQNPVVKHLLQQCRLVERILTSWEENDRVQCAGGPRKGYMGHLTRVAGALVQNTEKGPNAEQLRQLLKELPSEQQEQWEAFVSGPLAETNKKNMVDLVNTHHLHSSSDDEDDRLKEFNFPEEAVLQQAFMDFQMQRMTSAFIDHFGFNDEEFGEQEESVNAPFDKTANITFSLNADDENPNANLLEICYKDRIQQFDDDEEEEDEEEAQGSGESDGEDGAWQGSQLARGARLGQPPGVRSGGSTDSEDEEEEDEEEEEDEEGIGCAARGGATPLSYPSPGPQPPGPSWTATFDPVPTDAPTSPRVSGEEELHTGPPAPQGPLSVPQGLPTQSLASPPARDALQLRSQDPTPPSAPQEATEGSKVTEPSAPCQALVSIGDLQATFHGIRSAPSSSDSATRDPSTSVPASGAHQPPQTTEGEKSPEPLGLPQSQSAQALTPPPIPNGSAPEGPASPGSQ

SEQ ID NO: 7251 - protein, 117 aa, Homo sapiens
MKFQYKEVHPFEYRKKEGEKIRKKYPDRVPLIVEKAPKARVPDLDRRKYLVPSDLTDGQFYLLIRKRIHLRPEDALFFFVNNTIPPTSATMGQLYEDSHEEDDFLYVAYSNESVYGK

SEQ ID NO: 7252 - protein, 362 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 7253 - protein, 217 aa, Homo sapiens
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVASTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDL

SEQ ID NO: 7254 - protein, 395 aa, Homo sapiens; identical to SEQ ID NO: 6506

SEQ ID NO: 7255 - protein, 33 aa, Homo sapiens
MSISSDEVNFLVYRYLQESGFSHSAFTFGIESH

SEQ ID NO: 7256 - protein, 413 aa, Homo sapiens
MFASDLLRALDCCPGAGSSGLLPQLGPRQLLAFTVNCLGNHRYLGFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 7257 - protein, 629 aa, Homo sapiens
MEESPLSRAPSRGGVNFLNVARTYIPNTKVECHYTLPPGTMPSASDWIGIFKVEAACVRDYHTFVWSSVPESTTDGSPIHTSVQFQACNQLDESQQERNDLMQLKLQLEGQVTELRSRVQELERALATARQEHTELMEQYKGISRSHGEITEERDILSRQQGDHVARILELEDDIQTISEKVLTKEVELDRLRDTVKALTREQEKLLGQLKEVQADKEQSEAELQVAQQENHHLNLDLKEAKSWQEEQSAQAQRLKDKVAQMKDTLGQAQQRVAELEPLKEQLRGAQELAASSQQKATLLGEELASAAAARDRTIAELHRSRLEVAEVNGRLAELGLHLKEEKCQWSKERAGLLQSVEAEKDKILKLSAEILRLEKAVQEERTQNQVFKTELAREKDSSLVQLSESKRELTELRSALRVLQKEKEQLQEEKQELLEYMRKLEARLEKVADEKWNEDATTEDEEAAVGLSCPAALTDSEDESPEDMRLPPYGLCERGDPGSSPAGPREASPLVVISQPAPISPHLSGPAEDSSSDSEAEDEKSVLMAAVQSGGEEANLLLPELGSAFYDMASGFTVGTLSETSTGGPATPTWKECPICKERFPAESDKDALEDHMDGHFFFSTQDPFTFE

SEQ ID NO: 7258 - protein, 816 aa, Homo sapiens
MPLSSPNAAATASDMDKNSGSNSSSASSGSSKGQQPPRSASAGPAGESKPKSDGKNSSGSKRYNRKRELSYPKNESFNNQSRRSSSQKSKTFNKMPPQRGGGSSKLFSSSFNGGRRDEVAEAQRAEFSPAQFSGPKKINLNHLLNFTFEPRGQTGHFEGSGHGSWGKRNKWGHKPFNKELFLQANCQFVVSEDQDYTAHFADPDTLVNWDFVEQVRICSHEVPSCPICLYPPTAAKITRCGHIFCWACILHYLSLSEKTWSKCPICYSSVHKKDLKSVVATESHQYVVGDTITMQLMKREKGVLVALPKSKWMNVDHPIHLGDEQHSQYSKLLLASKEQVLHRVVLEEKVALEQQLAEEKHTPESCFIEAAIQELKTREEALSGLAGSRREVTGVVAALEQLVLMAPLAKESVFQPRKSLLQQGVLEYLSAFDEETTEVCSLDTPSRPLALPLVEEEEAVSEPEPEGLPEACDDLELADDNLKEGTICTESSQQEPITKSGFTRLSSSPCYYFYQAEDGQHMFLHPVNVRCLVREYGSLERSPEKISATVVEIAGYSMSEDVRQRHRYLSHLPLTCEFSICELALQPPVVSKETLEMFSDDIEKRKRQRQKKAREERRRERRIEIEENKKQGKYPEVHIPLENLQQFPAFNSYTCSSDSALGPTSTEGHGALSISPLSRSPGSHADFLLTPLSPTASQGSPSFCVGSLEEDSPFPSFAQMLRVGKAKADVWPKTAPKKDENSLVPPAPVDSDGESDNSDRVPVPSFQNSFSQAIEAAFMKLDTPATSDPLSEEKGGKKRKKQKQKLLFSTSVVHTK

SEQ ID NO: 7259 - protein, 142 aa, Homo sapiens
MASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQ

SEQ ID NO: 7260 - protein, 98 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFS

SEQ ID NO: 7261 - protein, 638 aa, Homo sapiens
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEANASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 7262 - protein, 509 aa, Homo sapiens
MKRGRLPSSSEDSDDNGSLSTTWSQNSRSQHRRSSCSRHEDRKPSEVFRTDLITAMKLHDSYQLNPDEYYVLADPWRQEWEKGVQVPVSPGTIPQPVARVVSEEKSLMFIRPKKYIVSSGSEPPELGYVDIRTLADSVCRYDLNDMDAAWLELTNEEFKEMGMPELDEYTMERVLEEFEQRCYDNMNHAIETEEGLGIEYDEDVVCDVCQSPDGEDGNEMVFCDKCNICVHQACYGILKVPEGSWLCRTCALGVQPKCLLCPKKGGAMKPTRSGTKWVHVSCALWIPEVSIGSPEKMEPITKVSHIPSSRWALVCSLCNEKFGASIQCSVKNCRTAFHVTCAFDRGLEMKTILAENDEVKFKSYCPKHSSHRKPEESLGKGAAQENGAPECSPRNPLEPFASLEQNREEAHRVSVRKQKLQQLEDEFYTFVNLLDVARALRLPEEVVDFLYQYWKLKRKVNFNKPLITPKKDEEDNLAKREQDVLFRRLQLFTHLRQDLERVMIDTDTL

SEQ ID NO: 7263 - protein, 117 aa, Homo sapiens
MAFSGRARPCIIPENEEIPRAALNTVHEANGTEDERAVSKLQRRHSDVKVYKEFCDFYAKFNMANALASATCERCKGGFAPAETIVNSNGELYHEQCFVCAQCFQQFPEGLFYEERT

SEQ ID NO: 7264 - protein, 369 aa, Homo sapiens
MKDTQDIQEASKAMQNKVHEQEDKNEKQKQREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7265 - protein, 226 aa, Homo sapiens
MDQSRVLLWVKAEPFIVGALQVPPPSKFSLHYLRKISTYVQIRATEGAYPRLYWSTWRHIACGKLQLAKDLAWLYFEIFDSLSMKTPEERLEWSEVLSNCMSEEEVEKQRNQLSVDTLQFLLFLYIQQLNKVSLRTSLIGEEWPSPRNKSQSPDLTEKSNCHNKNWNDYSHQAFVYDHLSDLLELLLDPKQLTASFHSTHSSLVSREAVVALSFLIEGTISRARKI

SEQ ID NO: 7266 - protein, 248 aa, Homo sapiens
MNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDLLLASGLPDLNGVGPRGLLVDNMLWSRLVVSFASHGQGLAPLVAHVASVVWTWWLLHPTVASVVWTWWLLHPTQGNSVLLHPTDCWERASGTFLWGIILFCLS

SEQ ID NO: 7267 - protein, 622 aa, Homo sapiens; identical to SEQ ID NO: 5475

SEQ ID NO: 7268 - protein, 1335 aa, Homo sapiens
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 7269 - protein, 914 aa, Homo sapiens
MEERITTLEKRYLAAQREATSIHDLNDKLENELANKESLHRQCEEKARHLQELLEVAEQKLQQTMRKAETLPEVEAELAQRIAALTKAEERHGNIEEHLRQLEGQLEEKNQELARVRQREKMNEDHNKRLSDTVDRLLSESNERLQLHLKERMAALEEKNTLIQELESSQRQIEEQHHHKGRLSEEIEKLRQEVDQLKGRGGPFVDGVHSRSHMGSAADVRFSLGTTTHAPPGVHRRYSALREESAKDWETSPLPGMLAPAAGPAFDSDPEISDVDEDEPGGLVGSADVVSPSGHSDAQTLAMMLQEQLDAINEEIRMIQEEKESTELRAEEIETRVTSGSMEALNLKQLRKRGSIPTSLTALSLASASPPLSGRSTPKLTSRSAAQDLDRMGVMTLPSDLRKHRRKLLSPVSREENREDKATIKCETSPPSSPRTLRLEKLGHPALSQEEGKSALEDQGSNPSSSNSSQDSLHKGAKRKGIKSSIGRLFGKKEKGRLIQLSRDGATGHVLLTDSEFSMQEPMVPAKLGTQAEKDRRLKKKHQLLEDARRKGMPFAQWDGPTVVSWLELWVGMPAWYVAACRANVKSGAIMSALSDTEIQREIGISNALHRLKLRLAIQEMVSLTSPSAPPTSRTSSGNVWVTHEEMETLETSTKTDSEEGSWAQTLAYGDMNHEWIGNEWLPSLGLPQYRSYFMECLVDARMLDHLTKKDLRVHLKMVDSFHRTSLQYGIMCLKRLNYDRKELEKRREESQHEIKDVLVWTNDQVVHWVQSIGLRDYAGNLHESGVHGALLALDENFDHNTLALILQIPTQNTQARQVMEREFNNLLALGTDRKLDDGDDKVFRRAPSWRKRFRPREHHGRGGMLSASAETLPAGFRVSTLGTLQPPPAPPKKIMPEAHSHYLYGHMLSAFRD

SEQ ID NO: 7270 - protein, 497 aa, Homo sapiens
DVGGDRPWDSGNTQLPPRNPVKANAMFGAGDEDDTDFLSPSGGARLASLFGLDQAAAGHGNEFFQYTAPKQPKKGQGTAATGNQATPKTAPATMSTPTILVATAVHAYRYTNGQYVKQGKFGAAVLGNHTAREYRILLYISQQQPVTVARIHVNFELMVRPNNYSTFYDDQRQNWSIMFESEKAAVEFNKQVCIAKCNSTSSLDAVLSQDLIVADGPAVEVGDSLEVAYTGWLFQNHVLGQVFDSTANKDKLLRLKLGSGKVIKGWEDGMLGMKKGGKRLLIVPPACAVGSEGVIGWTQATDSILVFEVEVRRVKFARDSGSDGHSVSSRDSAAPSPIPGADNLSADPVVSPPTSIPFKSGEPALRTKSNSLSEQLAINTSPDAVKAKLISRMAKMGQPMLPILPPQLDSNDSEIEDVNTLQGGGQPVVTPSVQPSLHPAHPALPQMTSQAPQPSVTGLQAPSAALMQVSSLDSHSAVSGNAQSFQVTFYNRINYIL

SEQ ID NO: 7271 - protein, 153 aa, Homo sapiens
MNLAEICDNAKKGREYALLGNYDSSMVYYQGVMQQIQRHCQSVRDPAIKGKWQQVRQELLEEYEQVKSIVSTLESFKIDKPPDFPVSCQDEPFRDPAVWPPPVPAEHRAPPQIRRPNREVRPLRKEMAGVGARGPVGRAHPISKSEKPSTSRD

SEQ ID NO: 7272 - protein, 208 aa, Homo sapiens
MFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPTRNSRDRVAMFSFPFAQMSGVGRGLVLCEPGCSASPGRHDSCLETRAFQMAGRCLCGDEMGHPWPSLMCSPGLRGTGRGVRVGRWGRAWSLDQQPAS

SEQ ID NO: 7273 - protein, 196 aa, Homo sapiens
MPFSKEKYILDSSPEKLHKELEEELKLSSTDLRSHAWYHGRIPREVSETLVQRNGDFLIRDSLTSLGDYVLTCRWRNQALHFKINKVVVKAGESYTHIQYLFEQESFDHVPALVRYHVGSRKAVSEQSGAIIYCPVNRTFPLRYLEASYGLGQGSSKPASPVSPSGPKGSHMKRRSVTMTDGLTADKVTRSDGCPT

SEQ ID NO: 7274 - protein, 661 aa, Homo sapiens
MQANGAGGGGGGGGGGGGGGGGGGGQGQTPELACLSAQNGESSPSSSSSAGDLAHANGLLPSAPSAASNNSNSLNVNNGVPGGAAAASSATVAAASATTAASSSLATPELGSSLKKKKRLSQSDEDVIRLIGQHLNGLGLNQTVDLLMQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 7275 - protein, 370 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLISLPLVPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 7276 - protein, 115 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYP

SEQ ID NO: 7277 - protein, 1012 aa, Homo sapiens
MLLKSIFIVYIFFYSISELSLDSTLHAVNLHCNNISKIEAIDHIWNLQHLDLSSNQISRIEGLNTLTKLCTLNLSCNLITKVEGLEELINLTRLNVSYNHIDDLSGLIPLHGIKHKLRYIDLHSNRIDSIHHLLQCMVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHNERKEKLKQQLKGKEVELEEIRKAYSTLNRKWHDKGELLCHLETQVKEVKEKFENKEKKLKAERDKSIELQKNAMEKLHSMDDAFKRQVDAIVEAHQAEIAQLANEKQKCIDSANLKVHQIEKEMRELLEETCKNKKTMEAKIKQLAFALNEIQQDM

SEQ ID NO: 7278 - protein, 1554 aa, Homo sapiens
MSATSWFLVSSSGARHRLPRELIFVGREECELMLQSRSVDKQHAVINYDQDRDEHWVKDLGSLNGTFVNDMRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSTTQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 7279 - protein, 231 aa, Homo sapiens
IILLLVPSEETDENDLILEVTAGVGGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 7280 - protein, 160 aa, Homo sapiens; identical to SEQ ID NO: 6461

SEQ ID NO: 7281 - protein, 140 aa, Homo sapiens
MQFGELLAAVRKAQANVMLFLEEKEQAALSQANGIKAHLEYRSAEMEKSKQELETMAAISNTVQFLEMCMTSRSTRTQHTSISGCRRRTARSPTPRPGSIPTRTSPAGSCTGGRCCPSRVCTCTGTILRWRSSGQAPMLA

SEQ ID NO: 7282 - protein, 272 aa, Homo sapiens
MASSNTVLMRLVASAYSIAQKAGMIVRRVIAEGDLGIVEKTCATDLQTKADRLAQMSICSSLARKFPKLTIIGEELVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 7283 - protein, 201 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLP

SEQ ID NO: 7284 - protein, 634 aa, Homo sapiens
MALSKRELDELKPWIEKTVKRVLGFSEPTVVTAALNCVGKGMDKKKAADHLKPFLDDSTLRFVDKLFEAVEEGRSSRHSKSSSDRSRKRELKIKQMMEAATRQIEERKKQLSFISPPTPQPKTPSSSQPERLPIGNTIQPSQAATFMNDAIEKARKAAELQARIQAQLALKPGLIGNANMVGLANLHAMGIAPPKVELKDQTKPTPLILDEQGRTVDATGKEIELTHRMPTLKANIRAVKREQFKQQLKEKPSEDMESNTFFDPRVSIAPSQRQRRTFKFHDKGKFEKIAQRLRTKAQLEKLQAEISQAARKTGIHTSTRLALIAPKKELKEGDIPEIEWWDSYIIPNGFDLTEENPKREDYFGITNLVEHPAQLNPPVDNDTPVTLGVYLTKKEQKKLRRQTRREAQKELQEKVRLGLMPPPEPKVRISNLMRVLGTEAVQDPTKVEAHVRAQMAKRQKAHEEANAARKLTAEQRKVKKIKKLKEDISQGVHISVYRVRNLSNPAKKFKIEANAGQLYLTGVVVLHKDVNVVVVEGGPKAQKKFKRLMLHRIKWDEQTSNTKGDDDEESDEEAVKKTNKCVLVWEGTAKDRSFGEMKFKQCPTENMAREHFKKHGAEHYWDLALSESVLESTD

SEQ ID NO: 7285 - protein, 1063 aa, Homo sapiens
MPHLPLASFRPPFWGLRHSRGLPRFHSVSTQSEPHGSPISRRNREAKQKRLREKQATLEAEIAGESKSPAESIKAWRPKELVLYEIPTKPGEKKDVSGPLPPAYSPRYVEAAWYPWWVREGFFKPEYQARLPQATGETFSMCIPPPNVTGSLHIGHALTVAIQDALVRWHRMRGDQVLWVPGSDHAGIATQAVVEKQLWKERGVRRHELSREAFLREVWQWKEAKGGEICEQLRALGASLDWDRECFTMDVGSSVAVTEAFVRLYKAGLLYRNHQLVNWSCALRSAISDIEVENRPLPGHTQLRLPGCPTPVSFGLLFSVAFPVDGEPDAEVVVGTTRPETLPGDVAVAVHPDDSRYTHLHGRQLRHPLMGQPLPLITDYAVQPHVGTGAVKVTPAHSPADAEMGARHGLSPLNVIAEDGTMTSLCGDWLQGLHRFVAREKIMSVLSEWGLFRGLQNHPMVLPICSRSGDVIEYLLKNQWFVRCQEMGARAAKAVESGALELSPSFHQKNWQHWFSHIGDWCVSRQLWWGHQIPAYLVVEDHAQGEEDCWVVGRSEAEAREVAAELTGRPGAELTLERDPDVLDTWFSSALFPFSALGWPQETPDLARFYPLSLLETGSDLLLFWVGRMVMLGTQLTGQLPFSKVLLHPMVRDRQGRKMSKSLGNVLDPRDIISGVEMQVLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLTRELSLVTHALHHFWLHNLCDVYLEAVKPVLWHSPRPLGPPQVLFSCADLGLRLLAPLMPFLAEELWQRLPPRPGCPPAPSISVAPYPSACSLEHWRQPELERRFSRVQEVVQVLRALRATYQLTKARPRVLLQSSEPGDQGLFEAFLEPLGTLGYCGAVGLLPPGAAAPSGWAQAPLSDTAQVYMELQGLVDPQIQLPLLAARRYKLQKQLDSLTARTPSEGEAGTQRQQKLSSLQLELSKLDKAASHLRQLMDEPPAPGSPEL

SEQ ID NO: 7286 - protein, 705 aa, Homo sapiens
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQVSICMQSAYNEGTLMKFQKITGDARIPLPLDSFPVPVSTPEGLGTSSNNLGVPATEQRQESFEGFIARMCSPSPDATSGTGSQRKEEELSRNSRSSSEKKTKTGSH

SEQ ID NO: 7287 - protein, 428 aa, Homo sapiens
MAWQSRKGGHFREVAMQWKVTLTSRWGLLRHCQVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 7288 - protein, 308 aa, Homo sapiens; identical to SEQ ID NO: 5215

SEQ ID NO: 7289 - protein, 142 aa, Homo sapiens
MSLHGKRKEIYKYEAPWTVYAMNWSVRPDKRFRLALGSFVEEYNNKVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 7290 - protein, 410 aa, Homo sapiens
MAAPSPSGGGGSGGGSGSGTPGPVGSPAPGHPAVSSMQGFQINFCEKAQSKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 7291 - protein, 228 aa, Homo sapiens
MQLAVVSEEQDQNLNRLICWILMQFIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 7292 - protein, 366 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPSSPFQVTAGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 7293 - protein, 101 aa, Homo sapiens
MASAGTQHYSIGLRQKNSFKQSGPSGTVPATPPEKPSEGRVWPQAHQQVKPIWKLEKKQVETLSAGLGPGLLGVPPQPAYFFCPSTLCSSGTTAVIAGHSS

SEQ ID NO: 7294 - protein, 706 aa, Homo sapiens
MIDSVKLRRDSAADFFSHYEYLCALQNSVPLPAVRACLREGVLDFNADRLRGVDWAPLLSTLKINKDLPLVSIKSFFQPWLGDTGSDMNKFCRSRVPAIRYKDVTFQLCKALKGCLSISSVLKNLELNGLILRERDLTILAKGLNKSASLVHLSLANCPIGDGGLEIICQGIKSSITLKTVNFTGCNLTWQGADHMAKILKYQTMRRHEETWAESLRYRRPDLDCMAGLRRITLNCNTLIGDLGACAFADSLSEDLWLRALDLQQCGLTNEGAKALLEALETNTTLVVLDIRKNPLIDHSMMKAVIKKVLQNGRSAKSEYQWITSPSVKEPSKTAKQKRRTIILGSGHKGKATIRIVGLATKKPVSSGRKHSLGKEYYAPAPLPPGVSGFLPWRTAERAKRHRGFPLIKTRDICNQLQQPGFPVTVTVESPSSSEVEEVDDSSESVHEVPEKTSIEQEALQEKLEECLKQLKEERVIRLKVDKRVSELEHENAQLRNINFSLSEALHAQSLTNMILDDEGVLGSIENSFQKFHAFLDLLKDAGLGQLATMAGIDQSDFQLLGHPQMTSTVSNPPKEEKKALEDEKPEPKQNALGQMQNIQFQKITGDARIPLPLDSFPVPVSTPEGLGTSSNNLGVPATEQRQESFEGFIARMCSPSPDATSGTGSQRKEEELSRNSRSSSEKKTKTGEYTKKHSDKQHPGKDLHS

SEQ ID NO: 7295 - protein, 643 aa, Homo sapiens
MACQQSRYHSFSSASRLQPRPSGVTIDESFLTEDKSTQNRKLLQKRRTLELPAAPLSHCQAPVLGGTGKLPTQGAPPAGPGHRFHPGTKAAAHQREKIRALEPLKAKLVTVNEDCNERILAMRAEEKYEISLLKKEKMNLLKLIDKKNEEKISLQSEVTKLRKNLAEEYLHYLSERDACKILIADLNELRYQREDMSLAQSPGIWGEDPVKLTLALKMTRQDLTRTQMELNNMKANFGDVVPRRDFEMQEKTNKDLQEQLDTLRASYEEVRKEHEILMQLHMSTLKERDQFFSELQEIQRTSTPRPDWTKCKDVVAGGPERWQMLAEGKNSDQLVDVLLEEIGSGLLREKDFFPGLGYGEAIPAFLRFDGLVENKKPSKKDVVNLLKDAWKERLAEEQKETFPDFFFNFLEHRFGPSDAMAWAYTIFENIKIFHSNEVMSQFYAVLMGKRSENVYVTQKETVAQLLKEMTNADSQNEGLLTMEQFNTVLKSTFPLKTEEQIQELMEAGGWHPSSSNADLLNYRSLFMEDEEGQSEPFVQKLWEQYMDEKDEYLQQLKQELGIELHEEVTLPKLRGGLMTIDPSLDKQTVNTYMSQAFQLPESEMPEEGDEKEEAVVEILQTALERLQVIDIRRVGPREPEPAS

SEQ ID NO: 7296 - protein, 157 aa, Homo sapiens
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLR

SEQ ID NO: 7297 - protein, 312 aa, Homo sapiens
MAQPYPPAQYPPPPQNGIPAEYAPPPPHPTQDYSGQTPVPTEHGMTLYTPAQTHPEQPGSEASTQPIAGTQTVPQTDEAAQTDSQPLHPSDPTEKQQPKRLHVSNIPFRFRDPDLRQMFGQFGKILDVEIIFNERGSKGFGFVTFETSSDADRAREKLNGTIVEGRKIEVNNATARVMTNKKTGNPYTNGWKLNPVVGAVYGPEFYAVTGFPYPTTGTAVAYRGAHLRGRGRAVYNTFRAAPPPPPIPTYGAVVYQDGFYGAEIYGGYAAYRYAQPAAAAAAYSDSYGRVYAAADPYHHTIGPAATYSIGTM

SEQ ID NO: 7298 - protein, 99 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRR

SEQ ID NO: 7299 - protein, 539 aa, Homo sapiens; identical to SEQ ID NO: 5502

SEQ ID NO: 7300 - protein, 159 aa, Homo sapiens
MATSAPLRSLEEEVTCSICLDYLRDPVTIDCGHVFCRSCTTDVRPISGSRPVCPLCKKPFKKENIRPVWQLEKILNHLSTLRRDRDKIQGFQAKGEADILAALKKLQDQRQYIVAEFEQGHQFLREREEHLLEQLAKLEQELTEGREKFKSRGVGELAR

SEQ ID NO: 7301 - protein, 192 aa, Homo sapiens; identical to SEQ ID NO: 6709

SEQ ID NO: 7302 - protein, 102 aa, Homo sapiens
MHNRSQGFFFSSCHPQNHVSYGCQSPSFIFCRCQSLNFVSRTCYPLSYFSYGNQTIGSISNSFRSLNYVSHSFQPISFMHSSFQPACSDFVGWQSPFLRRTC

SEQ ID NO: 7303 - protein, 240 aa, Homo sapiens
MDLVRLGLERGETAKEALDVIVSLLEEHGQGGNYFEDANSCHSFQSAYLIVDRDEAWVLETIGKYWAAEKVTESITVQTMMNTLRDKASGVCIDSEFFLTTASGVSVLPQNRSSPCIHYFTGTPDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 7304 - protein, 299 aa, Homo sapiens
  MOD_RES (1)..(1): Any amino acid
XREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEACILSPHPALGQPSSSREYPSLTGQELGPQLR

SEQ ID NO: 7305 - protein, 346 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 7306 - protein, 131 aa, Homo sapiens
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRVTH

SEQ ID NO: 7307 - protein, 101 aa, Homo sapiens
MPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDM

SEQ ID NO: 7308 - protein, 130 aa, Homo sapiens
MDISKGLPGMQGGLHIWISENRKMVPVPEGAYGNFFEEHCYVILHVPQSPKATQGASSDLHYWVGKQAGAEAQGAAEAFQQRLQDELGGQTVLHREAQGHESDCFCSYFRPGIIYRKGGLASDLKHVETN

SEQ ID NO: 7309 - protein, 16 aa, Homo sapiens
MCTSETFQALDTFEAR

SEQ ID NO: 7310 - protein, 1850 aa, Homo sapiens
MESNFNQEGVPRPSYVFSADPIARPSEINFDGIKLDLSHEFSLVAPNTEANSFESKDYLQVCLRIRPFTQSEKELESEGCVHILDSQTVVLKEPQCILGRLSEKSSGQMAQKFSFSKVFGPATTQKEFFQGCIMQPVKDLLKGQSRLIFTYGLTNSGKTYTFQGTEENIGILPRTLNVLFDSLQERLYTKMNLKPHRSREYLRLSSEQEKEEIASKSALLRQIKEVTVHNDSDDTLYGSLTNSLNISEFEESIKDYEQANLNMANSIKFSVWVSFFEIYNEYIYDLFVPVSSKFQKRKMLRLSQDVKGYSFIKDLQWIQVSDSKEAYRLLKLGIKHQSVAFTKLNNASSRSHSIFTVKILQIEDSEMSRVIRVSELSLCDLAGSERTMKTQNEGERLRETGNINTSLLTLGKCINVLKNSEKSKFQQHVPFRESKLTHYFQSFFNGKGKICMIVNISQCYLAYDETLNVLKFSAIAQKVCVPDTLNSSQEKLFGPVKSSQDVSLDSNSNSKILNVKRATISWENSLEDLMEDEDLVEELENAEETQNVETKLLDEDLDKTLEENKAFISHEEKRKLLDLIEDLKKKLINEKKEKLTLEFKIREEVTQEFTQYWAQREADFKETLLQEREILEENAERRLAIFKDLVGKCDTREEAAKDICATKVETEETHNYVGFEDIIDSLQDNVADIKKQAEIAHLYIASLPDPQEATACLELKFNQIKAELAKTKGELIKTKEELKKRENESDSLIQELETSNKKIITQNQRIKELINIIDQKEDTINEFQNLKSHMENTFKCNDKADTSSLIINNKLICNETVEVPKDSKSKICSERKRVNENELQQDEPPAKKGTTSAASSRRLRKLISKPVNRTRQTEGHSLVSIHVSSAITEDQKKSEEVRPNIAEIEDIRVLQENNEGLRAFLLTIENELKNEKEEKAELNKQIVHFQQELSLSEKKNLTLSKEVQQIQSNYDIAIAELHVQKSKNQEQEEKIMKLSNEIETATRSITNNVSQIKLMHTKIDELRTLDSVSQISNIDLLNLRDLSNGSEEDNLPNTQLDLLGNDYLVSKQVKEYRIQEPNRENSFHSSIEAIWEECKEIVKASSKKSHQIEELEQQIEKLQAEVKGYKDENNRLKEKEHKNQDDLLKEKETLIQQLKEELQEKNVTLDVQIQHVVEGKRALSELTQGVTCYKAKIKELETILETQKVECSHSAKLEQDILEKESIILKLERNLKEFQEHLQDSVKNTKDLNVKELKLKEEITQLTNNLQDMKHLLQLKEEEEETNRQETEKLKEELSASSARTQNLKADLQRKEEDYADLKEKLTDAKKQIKQVQKEVSVMRDEDKLLRIKINELEKKKNQCSQELDMKQRTIQQLKEQLNNQKVEEAIQQYERACKDLNVKEKIIEDMRMTLEEQEQTQVEQDQVLEAKLEEVERLATELEKWKEKCNDLETKNNQRSNKEHENNTDVLGKLTNLQDELQESEQKYNADRKKWLEEKMMLITQAKEAENIRNKEMKKYAEDRERFFKQQNEMEILTAQLTEKDSDLQKWREERDQLVAALEIQLKALISSNVQKDNEIEQLKRIISETSKIETQIMDIKPKRISSADPDKLQTEPLSTSFEISRNKIEDGSVVLDSCEVSTENDQSTRFPKPELEIQFTPLQPNKMAVKHPGCTTPVTVKIPKARKRKSNEMEEDLVKCENKKNATPRTNLKFPISDDRNSSVKKEQKVAIRPSSKKTYSLRSQASIIGVNLATKKKEGTLQKFGDFLQHSPSILQSKAKKIIETMSSSKLSNVEASKENVSQPKRAKRKLYTSEISSPIDISGQVILMDQKMKESDHQIIKRRLRTKTAK

SEQ ID NO: 7311 - protein, 508 aa, Homo sapiens; identical to SEQ ID NO: 6586

SEQ ID NO: 7312 - protein, 324 aa, Homo sapiens
MFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSVLNSYSAQPNFGAPASPAGSNPARPGGFPGANSPGPVADLYGPASQDSGVGNYISAASPQPGSGFGHGIAGPLIATAFTNGYH

SEQ ID NO: 7313 - protein, 110 aa, Homo sapiens
  MOD_RES (1)..(1): Any amino acid
XHKPCYGALFGPRGVNIGGVGSYLYNPPTPSPGCTTPLSPSSFSPPRPRTGLPQGKKTEKVMSLGRNWHRPCLRCQRCHKTLTAGSHAEHDGVPYCHVPCYGYLFGPKAL

SEQ ID NO: 7314 - protein, 136 aa, Homo sapiens
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLA

SEQ ID NO: 7315 - protein, 561 aa, Homo sapiens
MASQFCLPESPCLSPPPLSPLALAPSSAIRDQRTATKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDHAFDDKASNELVYQFTAQPLVESIFRKGMATCFAYGQTGSGKTYTMGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTPVNAHSSRSHAVFQIILKSGRIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 7316 - protein, 124 aa, Homo sapiens
  MOD_RES (1)..(1): Any amino acid
XSACIGNCSTALEELTDDMTEDFLPVLREYILYSDSMKSVLKKRDQVQAEYEAKLEAVALRKEDRPKVPADVEKCQDRMECFNADLKADMERWQNNKRQDFRQLLMGMADKNIQYYEKSIADLK

SEQ ID NO: 7317 - protein, 248 aa, Homo sapiens; identical to SEQ ID NO: 7249

SEQ ID NO: 7318 - protein, 374 aa, Homo sapiens
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATLWNDEVDKAEQELRVAQTEFDRQAEVTRLLLEGISSTHVNHLRCLHEFVKSQTTYYAQCYRHMLDLQKQLGRFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 7319 - protein, 395 aa, Homo sapiens; identical to SEQ ID NO: 6506

SEQ ID NO: 7320 - protein, 376 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVVYQDGFYGADLYGGYAAYRYAQPATATAATAAAAAAAAYSDGYGRVYTADPYHALAPAASYGVGAVASLYRGGYSRFAPY

SEQ ID NO: 7321 - protein, 545 aa, Homo sapiens
MGTPWRPPSRRPWRWPTGCTRKTCGPPTWSLERTRSWLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 7322 - protein, 206 aa, Homo sapiens
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRVSRDHTTDSGGEPQTTWGSQESSLRKTDSRGYLVRSQWSRISRSPSTKAPSIDEPRSRNTSAKLPSSSTSSRTPSTSPSLHDSSPPPLSGQPSLQPPASPQLPRSL

SEQ ID NO: 7323 - protein, 137 aa, Homo sapiens
MAPGTPKSLLLSASIKREGESPTASPHSSATDDLHHSDRYQTFLRVRANRQTRLNARIGKMKRRKQDEGQVCPLCNRPLAGSEQEMSRHVEHCLSKREGSCMAEDDAVDIEHENNNRFEEYEWCGQKRIRATTLLEG

SEQ ID NO: 7324 - protein, 189 aa, Homo sapiens
MIPICPVVSFTYVPSRLGEDAKMATGNYFGFTHSGAAAAAAAAQYSQQPASGVAYSHPTTVASYTVHQAPVAAHTVTAAYAPAAATVAVARPAPVAVAAAATAAAYGGYPTAHTATDYGYTQRQQEAPPPPPPATTQNYQDSYSYVRSTAPAVAYDSKQYYQQPAATEAGSSSSCCCCCNSCLDRDHLY

SEQ ID NO: 7325 - protein, 128 aa, Homo sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHA

SEQ ID NO: 7326 - protein, 126 aa, Homo sapiens
MWTARGPFRRDRWSSEDEEAAGPSQALSPLLSDTRKIVSEGELDQLAQIRPLIFNFHEQTAIKDCLKILEEKTAAYDIMQEFMALELKNLPGEFNSGNQPSNREKNRYRDILPFQHHGYSGPNERT

SEQ ID NO: 7327 - protein, 303 aa, Homo sapiens
EDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTD

SEQ ID NO: 7328 - protein, 960 aa, Homo sapiens
MEVQVSQASLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRANCFIMRNSLLLIKQQGGVILLR

SEQ ID NO: 7329 - protein, 581 aa, Homo sapiens
NNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 7330 - protein, 114 aa, Homo sapiens
MWSLTASEGESTTAHFFLGAGDEGLGTRGIGMRPEESDSELLEDEEDEVPPEPQIIVGICAMTKKSKSKPMTQILERLCRFDYLTVVILGEDVILNEPVENWPSCHCLISFHSK

SEQ ID NO: 7331 - protein, 305 aa, Homo sapiens
MEAESFPCLLRPFFKERSCALRPAFHTAKCEKLQKEKEELERRFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 7332 - protein, 772 aa, Homo sapiens
MQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQKFTQSMKLDGELGGQTLEHSTVLGLPAGAEERARKELARKHLAEHADTVQLVSGFEATINKFDKNFSAHLLDLLARLSIYSTSDCEHGMASVISRLDFNGFYTERLERLSAERSQKATPQVPVLRGPPAPAPRVAVTAQ

SEQ ID NO: 7333 - protein, 400 aa, Homo sapiens
MDFNMKKLASDAGIFFTRAVQFTEEKFGQAEKTELDAHFENLLARADSTKNWTEKILRQTEVLLQPNPSARVEEFLYEKLDRKVPSRVTNGELLAQYMADAASELGPTTPYGKTLIKVAEAEKQLGAAERDFIHTASISFLTPLRNFLEGDWKTISKERRLLQNRRLDLDACKARLKKAKAAEAKATTVPDFQETRPRNYILSASASALWNDEVDKAEQELRVAQTEFDRQAEVTRLLLEGISSTHVNHLRCLHEFVKSQTTYYAQCYRHMLDLQKQLGSSQGAIFPGTFVGTTEPASPPLSSTSPTTAAATMPVVPSVASLAPPGEASLCLEEVAPPASGTRKARVLYDYEAADSSELALLADELITVYSLPGMDPDWLIGERGNKKGKVPVTYLELLS

SEQ ID NO: 7334 - protein, 608 aa, Homo sapiens
MPFWPIRCLKRSRRMPRGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 7335 - protein, 235 aa, Homo sapiens [sequence omitted]

SEQ ID NO: 7336 - protein, 1170 aa, Homo sapiens
VYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 7337 - protein, 491 aa, Homo sapiens
VIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILQDINDEKSLSHLKSESKEPLKDSEFESLKTCNKSFEEDPKWSNPEPNDLKEENEDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKNTGTNRTQKQLDINGSSDSSTLPKLEEFCTSLTQSEQSADGSQSEPNNSQTQPKQIQLSTAAPCSTTAVDDSAEKPSGSVESSPEILKNEDFSSSRAITLYKDKRQESVDQLSLILSYECQISQKLYIPRSTATAALGAAARLATSRSLLHWYPSVKRMEA

SEQ ID NO: 7338 - protein, 141 aa, Homo sapiens
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAG

SEQ ID NO: 7339 - protein, 395 aa, Homo sapiens; identical to SEQ ID NO: 6506

SEQ ID NO: 7340 - protein, 447 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQSIRIQRMLPRNCQMLLFSATFEDSVWKFAQKVVPDPNVIKLKREEETLDTIKQYYVLCSSRDEKFQALCNLYGAITIAQAMIFCHTRKTASWLAAELSKEGHQVALLSGEMMVEQRAAVIERFREGKEKVLVTTNVCARGIDVEQVSVVINFDLPVDKDGNPDNETYLHRIGRTGRFGKRGLAVNMVDSKHSMNILNRIQEHFNKKIERLDTDDLDEIEKIAN

SEQ ID NO: 7341 - protein, 209 aa, Homo sapiens
MASSDLEQLCSHVNEKIGNIKKTLSLRNCGQEPTLKTVLNKIGDEIIVINELLNKLELEIQYQEQTNNSLKELCESLEEDYKDIEHLKENVPSHLPQVTVTQSWYMKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 7342 - protein, 374 aa, Homo sapiens
MDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 7343 - protein, 762 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 7344 - protein, 486 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPDAAAGGAQTLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDD

SEQ ID NO: 7345 - protein, 714 aa, Homo sapiens
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGTARRSHAHPLEPLPPGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 7346 - protein, 126 aa, Homo sapiens; identical to SEQ ID NO: 7326

SEQ ID NO: 7347 - protein, 813 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 7348 - protein, 488 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGTINSMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 7349 - protein, 157 aa, Homo sapiens; identical to SEQ ID NO: 7296

SEQ ID NO: 7350 - protein, 100 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPAL

SEQ ID NO: 7351 - protein, 152 aa, Homo sapiens
MSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEV

SEQ ID NO: 7352 - protein, 180 aa, Homo sapiens
MFASDLLRALDCCPGAGSSGLLPQLGPRQLLAFTVNCLGNHRYLGFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERME

SEQ ID NO: 7353 - protein, 828 aa, Homo sapiens; identical to SEQ ID NO: 6028

SEQ ID NO: 7354 - protein, 1484 aa, Homo sapiens
MRIPDQKYVTLKLNDVIRFGYDSNMYVLERVQHRVPEEALKHEKYTSQLQVSVKGLAPKRSEALPEHTPYCEASNPRPEKGDRRPGTEAASYRTPLYGQPSWWGEDDGSTLPDAQRQGEPYPERPKGPVQQDGELHGFRAPAEPQGCSFRREPSYFEIPTKETPQPSQPPEVPAHEMPTKDAEAGGGGAAPVVQSHASFTIEFDDCSPGKMKIKDHITKFSLRQRRPPGKEATPGEMVSAETKVADWLVQNDPSLLHRVGPGDDRHSTKSDLPVHTRTLKGHKHEDGTQSDSEDPLAKAASAAGVPLEASGEQVRLQRQIKRDPQELLHNQQAFVIEFFDEDTPRKKRSQSFTHSPSGDPKADKRRGPTPADRDRPSVPAPVQAGGRSSGPQRAGSLKREKTEERLGSPSPASRTPARPFGSVGRRSRLAQDFMAQCLRESSPAARPSPEKVPPVLPAPLTPHGTSPVGPPTPPPAPTDPQLTKARKQEEDDSLSDAGTYTIETEAQDTEVEEARKMIDQVFGVLESPELSRASSATFRPVIRGDRDESDDGGVAQRMALLQEFASRPLGAAPQAEHQGLPVPGSPGGQKWVSRWASLADSYSDPGLTEDGLGRRGGEPEGSLPVRMRRRLPQLPSERADSPAGPESSRRSGPGPPELDSEQPSRLFGQEELDPDSLSDASGSDGGRGPEPGVEPQDSRRRSPQEGPTWSRGRRSPRAPGEPTPASFFIGDQNGDAVLSRKPLAAPGDGEGLGQTAQPSPPARDGVYVSANGRMVIQLRPGRSPEPDGPAPAFLRQESFTKEPASGPPAPGKPPHISSHPLLQDLAATRAARMDFHSQDTHLILKETETALAALEARLLSNSVDAECEGGSTPRPPEDALSGDSDVDTASTVSLRSGKSGPSPTTPQPLRAQKEMSPSPPAAQDPGGTALVSAREQSSERQHHPLGPTDMGRGEPVRRSAIRRGHRPRGSLDWPSEERGPVLAHLPSSDVMASNHETPEATGAGRLGSRRKPAAPPPSPAAREEQSRSSASSQKGPQALTRSNSLSTPRPTRASRLRRARLGDASDTEAADGERGSLGNPEPVGRPAAEQAKKLSRLDILAMPRKRAGSFTGTSDPEAAPARTSFSGRSVELCCASRKPTMAEARAVSRKAANTATTTGPRQPFSRARSGSARYTSTTQTPRAGSSSRARSRAPGPRDTDDDEEEPDPYGFIVQTAEIAEIARLSQTLVKDVAILAQEIHDVAGDGDTLGSSEPAHSASLSNMPSTPASTISAREELVQRIPEASLNFQKVPPGSLNSRDFDQNMNDSCEDALANKTRPRNREEVIFDNLMLNPVSQLSQAIRENTEHLAEKMKILFQNTGRAWEDLEARINAENEVPILKTSNKEISSILKELRRVQKQLEVINAIVDPSGSLDLLTGNRSLASSAQPGLGKGRVAAQSPPSPASAEALLPALPLRNFPQRASCGPPSLPDPTFLPDAERFLI

SEQ ID NO: 7355 - protein, 49 aa, Homo sapiens
MYPNPLIYCTCWDPWNLGPRKLIKTPQLPRKNSTGSSKLTPLVPAPKNH

SEQ ID NO: 7356 - protein, 315 aa, Homo sapiens; identical to SEQ ID NO: 4781

SEQ ID NO: 7357 - protein, 1004 aa, Homo sapiens
MKATTPLQTVDRPKDWYKTMFKQIHMVHKPGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 7358 - protein, 326 aa, Homo sapiens
MAAAAAAAAATNGTGGSSGMEVDAAVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 7359 - protein, 259 aa, Homo sapiens
  MOD_RES (1)..(1): Any amino acid
XFTAQAPSGRGAAVGSGTRLASLRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQGFRPMSLSTQTVLVMLCSESAGALWRQRLS

SEQ ID NO: 7360 - protein, 345 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSGSISGDIIDELMSSDVFPLLRLSPTPADDYNFNLDDNEGVCDLFDVQILNY

SEQ ID NO: 7361 - protein, 31 aa, Homo sapiens
MTVPWRPGKRRITYKEEEDLTLQPRSCLQCS

SEQ ID NO: 7362 - protein, 162 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGT

SEQ ID NO: 7363 - protein, 89 aa, Homo sapiens
MAAATGDPGLSKLQFAPFSSALDVGFWHELTQKKLNEYRLDEAPKDIKGYYYNGDSAGLPARLTLEFSAFDMSAPTPARCCPAIGTLYN

SEQ ID NO: 7364 - protein, 674 aa, Homo sapiens; identical to SEQ ID NO: 5910

SEQ ID NO: 7365 - protein, 640 aa, Homo sapiens
MENQLAKSTEERTFQYQDSLPSLPVPSLEESLKKYLESVTRTCYQIRGLDPDAKRGFLDLTREGIQVKPFANQEEYKKTEEIVQKFQSGIGEKLHQKLLERAKGKRNWLEEWWLNVAYLDVRIPSQLNVNFAGPAAHFEHYWPPKEGTQLERGSITLWHNLNYWQLLRKEKVPVHKVGNTPLDMNQFRMLFSTCKVPGITRDSIMNYFRTESEGRSPNHIVVLCRGRAFVFDVIHEGCLVTPPELLRQLTYIHKKCHSEPDGPGIAALTSEERTRWAKAREYLIGLDPENLALLEKIQSSLLVYSMEDSSPHVTPEDYSEIIAAILIGDPTVRWGDKSYNLISFSNGVFGCNCDHAPFDAMIMVNISYYVDEKIFQNEGRWKGSEKVRDIPLPEELIFIVDEKVLNDINQAKAQYLREASDLQIAAYAFTSFGKKLTKNKMLHPDTFIQLALQLAYYRLHGHPGCCYETAMTRHFYHGRTETMRSCTVEAVRWCQSMQDPSVNLRERQQKMLQAFAKHNKMMKDCSAGKGFDRHLLGLLLIAKEEGLPVPELFTDPLFSKSGGGGNFVLSTSLVGYLRVQGVVVPMVHNGYGFFYHIRDDRFVVACSAWKSCPETDAEKLVQLTFCAFHDMIQLMNSTHL

SEQ ID NO: 7366 - protein, 157 aa, Homo sapiens; identical to SEQ ID NO: 7296

SEQ ID NO: 7367 - protein, 143 aa, Homo sapiens
  MOD_RES (1)..(1): Any amino acid
XTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 7368 - protein, 164 aa, Homo sapiens
MVNSVIFFDITVDGKPLGRISIKQFADKIPKTAENFRALSTGEKGFRYKGSCFHRIIPGFMCQGGDFTHPNGTGDKSIYGEKFDDENLIRKHTGSGILSMANAGPNTNGSQFFICTAKTEWLDGKHVAFGKVKERVNIVEAMEHFGYRNSKTSKKITIADCGQF

SEQ ID NO: 7369 - protein, 155 aa, Homo sapiens
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSS

SEQ ID NO: 7370 - protein, 278 aa, Homo sapiens
MWPFPSRSLFPPPTQAWLQTVSSDPEAQGWGAWNETKEILGPEGGEGKEEKEEEEDAEEDQDGDAGFLLSLLEQENLAECPLPDQELEAIKMKVCAMEQAEGTPRPPGVQQQAEEEEGTAAGQLLSPETVGCPLSGTPEEKVEADHRSVYVGNVDYGGSAEELEAHFSRCGEVHRVTILCDKFSGHPKGYAYIEFATKGSVQAAVELDQSLFRGRVIKVLPKRTNFPGISSTDRGGLRGHPGSRGAPFPHSGLQGRPRLRPQGQNRARGKFSPWFSPY

SEQ ID NO: 7371 - protein, 43 aa, Homo sapiens
MSEQGDLNQAIAEEGGTEQETATPENGIVKSESLDEEEKLELQ

SEQ ID NO: 7372 - protein, 129 aa, Homo sapiens
MADEELEALRRQRLAELQAKHGDPGDAAQQEAKHREAEMRNSILAQVLDQSARARLSNLALVKPEKTKAVENYLIQMARYGQLSEKVSLDSLEELYCYLLYQNMASKGQLHLHWITEFLLTLRRNCWRE

SEQ ID NO: 7373 - protein, 761 aa, Homo sapiens
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLRVKFMYHKIDCFRRVPEADACNPSTLGGQGRWIT

SEQ ID NO: 7374 - protein, 157 aa, Homo sapiens; identical to SEQ ID NO: 7296

SEQ ID NO: 7375 - protein, 490 aa, Homo sapiens
MTIGRMENVEVFTAEGKGRGLKATKEFWAADIIFAERAYSAVVFDSLVNFVCHTCFKRQEKLHRCGQCKFAHYCDRTCQKDAWLNHKNECSAIKRYGKVPNENIRLAARIMWRVEREGTGLTEGCLVSVDDLQNHVEHFGEEEQKDLRVDVDTFLQYWPPQSQQFSMQYISHIFGVINCNGFTLSDQRGLQAVGVGIFPNLGLVNHDCWPNCTVIFNNGNHEAVKSMFHTQMRIELRALGKISEGEELTVSYIDFLNVSEERKRQLKKQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKKQ

SEQ ID NO: 7376 - protein, 496 aa, Homo sapiens
MWGRFLAPEASGRDSPGGARSFPAGPDYSSAWLPANESLWQATTVPSNHRNNHIRRHSIASDSGDTGIGTSCSDSVEDHSTSSGTLSFKPSQSLITLPTAHVMPSNSSASISKLRESLTPDGSKWSTSLMQTLGNHSRGEQDSSLDMKDFRPLRKWSSLSKLTAPDNCGQGGTVCREESRNGLEKIGKAKALTSQLRTIGPSCLHDSMEMLRLEDKEINKKRSSTLDCKYKFESCSKEDFRASSSTLRRQPVDMTYSALPESKPIMTSSEAFEPPKYLMLGQQAVGGVPIQPSVRTQMWLTEQLRTNPLEGRNTEDSYSLAPWQQQQIEDFRQGSETPMQVLTGSSRQSYSPGYQDFSKWESMLKIKEGLLRQKEIVIDRQKQQITHLHERIRDNELRAQHAMLGHYVNCEDSYVASLQPQYENTSLQTPFSEESVSHSQQGEFEQKLASTEKEVLQLNEFLKQRLSLFSEEKKKLEEKVGFSNKVELGQQHFLSI

SEQ ID NO: 7377 - protein, 360 aa, Homo sapiens
MAELQQLQEFEIPTGREALRGNHSALLRVADYCEDNYVQATDKRKALEETMAFTTQALASVAYQVGNLAGHTLRMLDLQGAALRQVEARMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 7378 - protein, 66 aa, Homo sapiens
MLRCGQMIFAQALVCRHLGRDWRWTQRKRQPDSYFSVLNAFIDRKDSYYSIHQIAQMGVGEGKSIG

SEQ ID NO: 7379 - protein, 491 aa, Homo sapiens
MEQPPAPKSKLKKLSEDSLTKQPEEVFDVLEKLGEGSYGSVFKAIHKESGQVVAIKQVPVESDLQEIIKEISIMQQCDSPYVVKYYGSYFKNTDLWIVMEYCGAGSVSDIIRLRNKTLIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 7380 - protein, 41 aa, Homo sapiens
MSSKGSSTDGRTDLANGSLSSSPEEMSGAEEGRETSSGIEV

SEQ ID NO: 7381 - protein, 314 aa, Homo sapiens
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETAGDLSHHRKLNIGS

SEQ ID NO: 7382 - protein, 499 aa, Homo sapiens
MPEIRVTPLGAGQDVGRSCILVSIAGKNVMLDCGMHMGFNDDVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 7383 - protein, 131 aa, Homo sapiens
GTISCSTGTLQRRNLGPERQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVI

SEQ ID NO: 7384 - protein, 228 aa, Homo sapiens
MSRERGSRSEEPGAGNRESGSREPGLAAAAMSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 7385 - protein, 217 aa, Homo sapiens
MNFSEVFKLSSLLCKFSPDGKYLASCVQYRLVVRDVNTLQILQLYTCLDQIQHIEWSADSLFILCAMYKRGLVQVWSLEQPEWHCKIDEGSAGLVASCWSPDGRHILNTTEFHLRITVWSLCTKSVSYIKYPKACLQGITFTRDGRYMALAERRDCKDYVSIFVCSDWQLLRYKILLYSLDGRLLSTYSAYEWSLGIKSVAWSPSSQFLAVGSYDGK

SEQ ID NO: 7386 - protein, 160 aa, Homo sapiens; identical to SEQ ID NO: 6461

SEQ ID NO: 7387 - protein, 316 aa, Homo sapiens
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLSPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGP

SEQ ID NO: 7388 - protein, 351 aa, Homo sapiens
MWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQGGILLVNNILWHLSPLGQVCPQLLYRASGEQLTHCTGPQWLLHASRPKWHPVGRQ

SEQ ID NO: 7389 - protein, 110 aa, Homo sapiens
MQISSEKEEDDNEKRQDPGDNWEEGGGGGGGMEKSSGPWNKTAPVQAPPAPVIVTETPEPAMTSGVYRPPGARLTTTRKTPQGPPEIYSDTQFPSLQSTAKHVESRKYLK

SEQ ID NO: 7390 - protein, 323 aa, Homo sapiens
MEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGGNYGGGPGYSSRGGYGGGGPGYGNQGGGYGGGGGYDGYNEGGNFGGGNYGGGGNYNDFGNYSGQQQSNYGPMKGGSFGGRSSGSPYGGGYGSGGGSGGYGSRRF

SEQ ID NO: 7391 - protein, 96 aa, Homo sapiens
NIQLVADGCCNLQKQIQITQLFGVPVVVALNVFKTDTRAEIDLVCELAKRAGAFDAVPCYHWSVGGKGSVDLARAVREAASKRSRFQFLYDVQPFS

SEQ ID NO: 7392 - protein, 160 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWL

SEQ ID NO: 7393 - protein, 159 aa, Homo sapiens; identical to SEQ ID NO: 7300

SEQ ID NO: 7394 - protein, 143 aa, Homo sapiens
MDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCME
